US007154027B2

(12) United States Patent
Demmer et al.

(10) Patent No.: US 7,154,027 B2
(45) Date of Patent: Dec. 26, 2006

(54) COMPOSITIONS ISOLATED FROM FORAGE GRASSES AND METHODS FOR THEIR USE

(76) Inventors: Jeroen Demmer, 59 Merriefield Avenue Forrest Hill, Auckland (NZ); Richard L. Forster, 36 Windermere Crescent Blockhouse Bay, Auckland (NZ); Michael Andrew Shenk, 39 Cape Horn Road Waikowhai, Auckland (NZ); Michael Geoffrey Norriss, 16 Ilam Road Riccarton, Christchurch (NZ); Matthew Glenn, 14 Waimarie Road Whenuapai, Auckland (NZ); Keith Martin Saulsbury, 8 Samuel Street, Christchurch (NZ); Claire Hall, 2/56 Rukutai Street Orakei, Auckland (NZ)

( * ) Notice: Subject to any disclaimer, the term of this patent is extended or adjusted under 35 U.S.C. 154(b) by 372 days.

(21) Appl. No.: 10/289,757

(22) Filed: Nov. 7, 2002

(65) Prior Publication Data

US 2003/0180751 A1    Sep. 25, 2003

Related U.S. Application Data

(60) Provisional application No. 60/337,703, filed on Nov. 7, 2001.

(51) Int. Cl.
C12N 15/29 (2006.01)
C12N 15/82 (2006.01)
C12N 15/04 (2006.01)
A01H 5/00 (2006.01)

(52) U.S. Cl. .................. 800/298; 800/278; 800/287; 800/290; 536/23.1; 435/410; 435/320.1; 435/419

(58) Field of Classification Search ............... 536/23.1, 536/23.6; 435/320.1, 419, 468, 410; 800/298, 800/278, 290, 287
See application file for complete search history.

(56) References Cited

U.S. PATENT DOCUMENTS

| | | | |
|---|---|---|---|
| 5,569,832 | A | 10/1996 | Holton et al. |
| 5,886,243 | A | 3/1999 | Chiang et al. |
| 5,908,975 | A | 6/1999 | Caimi et al. |
| 5,948,956 | A | 9/1999 | Lee et al. |
| 5,959,178 | A | 9/1999 | Fritig et al. |
| 5,986,173 | A | 11/1999 | Smeekens et al. |
| 6,015,943 | A | 1/2000 | Boudet et al. |
| 6,025,542 | A | 2/2000 | Smeekens et al. |
| 6,054,636 | A | 4/2000 | Fader |
| 6,080,920 | A | 6/2000 | Holton |
| 6,210,943 | B1 | 4/2001 | Akihama |
| 6,211,432 | B1 | 4/2001 | Boudet et al. |
| 6,252,135 | B1 | 6/2001 | Chiang et al. |
| 6,329,204 | B1 | 12/2001 | Cahoon et al. |
| 6,465,229 | B1 | 10/2002 | Cahoon et al. |
| 6,465,630 | B1 | 10/2002 | Choi et al. |

2002/0081693 A1    6/2002    Cahoon et al.

FOREIGN PATENT DOCUMENTS

| | | | |
|---|---|---|---|
| EP | 1 076 093 A1 | 2/2001 | |
| WO | WO 98/50570 | 11/1998 | |
| WO | WO 99/10498 | 3/1999 | |
| WO | WO 99/46395 | 9/1999 | |
| WO | 1 033 405 A2 | 2/2000 | |
| WO | WO 00/22099 | * | 4/2000 |
| WO | WO 00/46382 | 8/2000 | |
| WO | WO 01/34817 A2 | 5/2001 | |
| WO | WO 01/42475 A1 | 6/2001 | |
| WO | WO 01/55395 A1 | 8/2001 | |
| WO | WO 01/95691 A2 | 12/2001 | |
| WO | WO 01/95702 A1 | 12/2001 | |
| WO | WO 02/09501 A1 | 2/2002 | |
| WO | WO 02/10210 A2 | 2/2002 | |
| WO | WO 02/018606 | 3/2002 | |
| WO | WO 02/20717 A2 | 3/2002 | |
| WO | WO 02/20812 A1 | 3/2002 | |
| WO | WO 02/31130 A1 | 4/2002 | |
| WO | WO 02/50294 A1 | 6/2002 | |
| WO | WO 02/063021 A2 | 8/2002 | |
| WO | WO 03/000906 A2 | 1/2003 | |
| WO | WO 03/031622 A1 | 4/2003 | |

OTHER PUBLICATIONS

Meyer et al., Proc. Natl. Acad. Sci. USA 93:6869-6874, 1996.*
Nair et al., Plant Physiol. 123 (4), 1623-1634 (2000).*
Osakabe et al., Proc. Natl. Acad. Sci. USA 96:8955-8960, 1999.*
Wei, J, Z., et al., "cDNA Cloning and Expression Analysis of Sucrose: Fructan 6-Fructosyltransferase (6SFT) Gene in Big Bluegrass (Poa ampla)", *EMBL/GenBank/DDBJ databases*, (CT-1999) Accession No. Q9FR47.
Spenger, N., et al., "Purification, cloning, and functional expression of sucrose: fructan 6-fructosyltransferase, a key enzyme of fructan synthesis in barley", *Proc. Natl, Acad, Sci. U.S.A.* 92 11652-11656, 1995, Accession No. Q96466.
Castleden, C.K., et al., "Wheat sucrose-phosphatase (SPP1) mRNA", *EMBL/GenBank/DDBJ databases*, (OV-2000) Accession No. Q9AXK6.
Lunn, J.E., "Wheat sucrose-phosphatase (SPP3) mRNA", *EMBL/GenBank/DDBJ databases*, (Mar. 2001), Accession No. Q9ARG8.
Guerin, J.R., et al., "Complete Triticum aestivum sucrose Synthase type 1 mRNA", *EMBL/GenBank/DDBJ databases*, (Aug. 1997), Accession No. O82073.
Odegard, W., et al., "Isolation and sequence of a sucrose synthase cDNA from developingrice seeds", *Plant Sci.*, 113, 67-78, (1996), Accession No. P30298.
Fernandes, S.Q., et al., "Cloning of rice invertase genes", *EMBL/GenBank/DDBJ databases*, (May 1999), Accession No. Q9XGV7.

(Continued)

Primary Examiner—Stuart F. Baum
(74) Attorney, Agent, or Firm—Speckman Law Group; Ann Speakman; Janet Sleath

(57) ABSTRACT

Isolated polynucleotides encoding polypeptides active in lignin, fructan and tannin biosynthetic pathways are provided, together with expression vectors and host cells comprising such isolated polynucleotides. Methods for the use of such polynucleotides and polypeptides are also provided.

18 Claims, 8 Drawing Sheets

OTHER PUBLICATIONS

Kim, J.Y., et al., "Characterization of two members of the maize gene family, Incw3 and Incw4, encoding cell-wall invertases", *Gene*, 245:9-102, (2000), Accession No. Q9ZTQ4.

Heath, R.L., et al., Isolation of three 4-coumarate—CoA ligase cDNA homologues from Lolium perenne:, *EMBL/GenBank/DDBJ databases*, (Mar. 1998), Accession No. Q9M7S2.

Heath, R., et al., "Isolation of three 4-coumarate—CoA ligase CDNA homologues from Lolium perenn", *EMBL/GenBank/DDBJ databases*, (Mar. 1998), Accession No. Q9M7S1.

Hotze, M., et al., "Cinnamate 4-hydroxylase from Catharanthus roseus, and a strategy for the functional expression of plant cytochrome P450 proteins as translational fusions with P450 reductase in *Escherichia coli*", *FEBS Lett*, 374: 345-350, (1995) Accession No. P48522.

Luo, P., et al., "Isolation and Expression Analysis of Two CeH Homologous from Gossypium arboretum", *EMBL/GenBank/DDBJ databases*, (Jul. 2000), Accession No. Q9FUU5.

Auh, C.K., et al., "Structure and expression of cinnamyl alcohol dehydrogenase cDNAs from tall fescue (Festuca arundinacea)", *EMBL/GenBank/DDBJ databases*, (Sep. 1999), Accession No. Q947SO.

Auh, C.K., et al., "Structure and expression of cinnamyl alcohol dehydrogenase cDNAs from tall fescue (Festuca arundinacea)", *EMBL/GenBank/DDBJ databases*, (Sep. 1999), Accession No. Q947S3.

Jones, R.S., "The Drosphila Polycomb-group gene Enhancer of zeste contains a region with sequence similarity to trithorax", *Mol. Cell. Biol.*, 13: 6357-6366, 1993, Accession No. P42124.

Sasaki, T., et al., "Oryza sativa nipponbare (GA3) genomic DNA, chromosome 6, PAC clone:P0880A3", *EMBL/GenBank/DDBJ databases*, (Feb. 1999), Accession No. Q9XJ19.

Civardi, ., et al., "Nucleotide sequence of two cDNAs coding for caffeoyl-coenzyme A O- methyltransferase (CCoAOMT) and study of their expression in Zea mays", *Plant Gene Register PGR99-113*, Accession No. Q9XGD5.

Larsen, K., "Cinnamoyl CoA reductase from perennial ryegrass", *EMBL/GenBank/DDBJ databases*, (Jun. 2000), Accession No. Q9FUW8.

Heath, R.L., et al., "cDNA cloning and differential expression of three caffeic acid O-mytheltranferase homologues from Lolium perenne", *EMBL/GenBank/DDBJ databases*, (Nov. 1997), Accession No. Q9ZTUO.

Auh, C., et al., "Structure and expression of caffeic acid O-methyltransferase cDNAs from tall fescue (Festuca arundinacea)", *EMBL/GenBank/DDBJ databases*, (May 1999), Accession No. Q94GA7.

Baga, M., et al., "Molecular cloning and expression analysis of peroxidase genes from wheat", *Plant Mol. Biol.*, 29:647-662, (1995), Accession No. Q43220.

Chittoor, J.M., "Differential induction of a peroxidase gene family during infection of rice by Xanthomonas oryzae pb. Oryzae", *Mol. Plant Microbe Interact*, 10:861-871 (1997), Accession No. O22439.

Hori, M., et al., *EMBL/GenBank/DDBJ databases*, (Apr. 1993), Accession No. P37834.

Sasaki, T., et al., "Oryza sativa nipponbare (GA3) genomic DNA, chromosome 1, PAC clone: P0483G10", *EMBL/GenBank/DDBJ databases*, (Feb. 2001), Accession No. Q94DM6.

Grotewold, E., et al., "Isolation and characterization of a maize gene encoding chalcone flavonone isomerase", *Mol. Gen. Genet.*, 242: 1-8, (1994), Accession No. Q08704.

Haussuehl, K.K., et al., "Expression of chalcone Synthase genes in coleoptiles and primary leaves of Secale cereale L. after induction by UV radiation: evidence for a UV-rotective role of the coleoptile", *Bot. Acta*, 109: 229-238, (1996), Accession No. P53415.

Ichikawa, H., et al., "Molecular cloning and characterization of chalcone Synthase (CHS) gene from rice (Oryza sativa L)", *EMBL/GenBank/DDBJ databases*, (Mar. 2001), Accession No. Q9AVC2.

Meldgaard, M., "Expression of chalcone Synthase, dihydroflavonol reductase and flavanone-3-hydroxylase in mutants of barley deficient in anthocyanin and proantocyanidin biosynthesis", *Theor. Appl. Genet.*, 83: 695-706, (1002), Accession No. P28038.

Debiim G.B., et al., "Flavanone 3-hydroxylase transcripts and flavonol accumulation are temporally coordinate in maize anthers", *Plant J.*, 7: 703-713, (1995), Accession No. Q43262.

Luescher, M., et al., Cloning and functional analysis of sucrose:sucrose 1-fructosyltransferase from tall fescue:, *Plant Physiol.*, 124: 1217-1228, (2000), Accession No. Q9FSV7.

Ingram, J., et al., "Analysis of cDNA clones encoding sucrose-phosphate Synthase in relation to sugar interconversions associated with dehydration in the resurrection plant Craterostigma plant aginem Hochst", *Plant Physiol.*, 115: 113-121, (1997), Accession No. OO4932.

Minhas, J.S., et al., "Invertase genes from wheat anthers", *EMBL/GenBank/DDBJ databases*, (Oct. 1997), Accession No. O81119.

Fernandes, S.Q., et al., "Cloning of rice invertase genes", *EMBL/GenBank/DDBJ databases*, (Jun. 2000), Accession No. Q9LK19.

Albert, H.H., et al., "Differential expression of soluble acid invertase (SAI) genes correlates to differences in sucrose accumulation in sugarcane", *EMBL/GenBank/DDBJ databases*, (May 1998), Accession No. O65342.

Wei, J.Z., et al., "cDNA Cloning and Expression Analysis of Sucrose:Fructan 6-Fructosyltransferase (6-SFT) Gene in Big Bluegrass (Poa ampla)", *EMBL/GenBank/DDBJ databases*, (Oct. 1999).

Liao, Y.C., et al., "Nucleotide sequence of one of two tandem genes encoding phenylalanine ammonia-lyase in Triticum aestivum", *Plant Gene Register PGR96-102*), Accession No. Q43210.

Karvinen, T.M.A., et al., "Cloning and characterization of cDNA clones encoding phenylalanine ammonia-lyase in barley", *Plant Sci.*, 123: 143-150, (1997), Accession No. OO4876.

Kristiansen, K.N., et al., "Structure of the Hordeum vulgare gene encoding dihydroflavonol-4-reductase and molecular analysis of ant18 mutants blocked in flavonoid synthesis", *Mol. Gen. Genet.*, 230: 49-59, (1991), Accession No. P51106.

Chen, M., et al., "Microcolinearity in sh2-homologous regions of the maize, rice, and sorghum genomes", *Proc. Natl. Acad. Sci. U.S.A.*, 94: 3431-3435, (1997), Accession No. P93776.

Zhuang, C.X., et al., "Differential expression of a putative dihydroflavonol reductase gene in rice (Accession No. AF134807) (PGR 99-074)", *Plant Physiol.*, 120: 633-633, (1999), Accession No. Q9XHC8.

Larsen, K., "Cinnamoyl CoA reductase from perennial ryegrass", *Unpublished* (Jun. 15, 2000), Accession No. AAG09817.

Sasaki, T., et al., "Oryza sativa nipponbare (GA3) genomic DNA, chromosome 6, PAC clone:P0680A03", *Published only in Database*, (1999), Accession No. AB023482.

Buell, C.R., et al., "Oryza sativa chromosome 10 BAC OSJNBa))55O03 genomic sequence", *Unpublished* (Jun. 30, 2000), Accession No. AC073867.

Wing, R.A., et al., "Rice Genomic Sequence", *Unpublished*, (Sep. 24, 2002), Accession No. AC134237.

Auh, C.K., et al., "Structure and expression of caffeic acid O-methyltransferase cDNAs from tall fescue (Festuca arundinacea)", *Unpublished*, (May 25, 1999), Accession No. AF153824.

Auh, C.K., et al., "Structure and expression of caffeic acid O-methyltransferase cDNAs from tall fescue (Festuca arundinacea)", *Unpublished*, (May 25, 1999), Accession No. AF153825.

Auh, C.K., et al., "Structure and expression of caffeic acid O-methyltransferase cDNAs from tall fescue (Festuca arundinacea)", *Unpublished*, (May 25, 1999), Accession No. AF153823.

Heath, R.L., et al., "cDNA cloning and differential expression of three caffeic acid O-methyltransferase homologues from Lolium perenne", *Unpublished*, (Nov. 10, 1997), Accession No. Af033538.

Mc Alister, F.M., et al., "Sequence and expression of a stem-abundant caffeic acid O-methyltransferase cDNA from perennial ryegrass(Lolium perenne)", *Aust. J. Plant Physiol.*, 25, 225-235, (1998), Accession No. AF010291.

Auh, C.K., et al., "Structure and expression of caffeic acid O-methyltransferase cDNAs from tall fescue (Festuca arundinacea)", *Unpublished*, (May 25, 1999), Accession No. AF153826.

Heath, R.L., et al., "cDNA cloning and differential expression of three caffeic acid O-methyltransferase homologues from Lolium perenne", *Unpublished*, (Nov. 10, 1997), Accession No. AF033540.

Heath, R.L.., et al., "Isolation of three 4-coumarate—CoA ligase cDNA homologues from Lolium perenne", *Unpublished*, (Mar. 5, 1998), Accession No. AF052222.

Heath, R.L., "Isolation of three 4-coumarate—CoA ligase cDNA homologues from Lolium perenne", *Unpublished*, (Mar. 5, 1998), Accession No. AF052223.

Mc Alister, F.M., et al., "Perennial ryegrass (Lolium perenne) CAD cDNA sequence", *Unpublished*, (Jun. 16, 1997), Accession No. AF010290.

Auh, C.K., et al., "Structure and expression of cinnamyl alcohol dehydrogenase cDNAs from tall fescue (Festuca arundinacea)", *Unpublished*, (Sep. 21, 1999), Accession No. AF188293.

Auh, C.K., et al., "Structure and expression of cinnamyl alcohol dehydrogenase cDNAs from tall fescue (Festuca arundinacea)", *Unpublished*, (Sep. 21, 1999), Accession No. AF188292.

Auh, C.K., et al., "Structure and expression of cinnamyl alcohol dehydrogenase cDNAs from tall fescue (Festuca arundinacea)", *Unpublished*, (Sep. 21, 1999), Accession No. AF188295.

Auh, C.K., et al., "Structure and expression of cinnamyl alcohol dehydrogenase cDNAs from tall fescue (Festuca arundinacea)", *Unpublished*, (Sep. 21, 1999), Accession No. AF188294.

Selman-Houssein, G., et al., "Molecular cloning of cDNAs coding for three sugarcane enzymes involved in lignification", *Plant Sci.*, 143, 163-171, (1999), Accession No. AJ231135.

Laura, C., et al., "Nucleotide Sequence of two cDNAs coding for Caffeoyl-coenzyme A O-Methyltransferase (CCoAOMT) and study of their expression in Zea mays", *Plant Physiol.*, 120, 1206-1206, (1999), Accession No. AJ242980.

Halpin, C., et al., "Brown-midrib maize (bml) -a mutation affecting the cinnamyl alcohol dehydrogenase gene", *Plant J.*, 14 (5), 545-553, (1998), Accession No. AJ005702.

Civardi, L., et al., "Nucleotide Sequence of Two cDNAs Coding for Caffeoyl-coenzyme A O-Methyltransferase (CCdoAOMT) and Study of Their Expression in Zea mays (Accession No. AJ242980 and AJ242981 (PGR99-113)", *Plant Physiol.*, 120 (4), 1206-1206, (1999), Accession No. AJ242981.

Rigau, J., et al., "Molecular cloning cDNAs coding for three sugarcane enzymes involved in lignification", *Plant Sci.*, 143, 163-171, (1999), Accession No. AJ231134.

Selman-Housein, G., et al., "Molecular cloning of cDNAs coding for three sugarcane enzymes involved in lignification", *Plant Sci.*, 143, 163-171, (1999), Accession No. AJ231133.

Sasaki, T., et al., "Oryza sativa nipponbare (GA3) genomic DNA, chromosome 6, BAC clone:OSJNBa0O15114", *Published Only on Database*, (Jun. 21, 2000), Accession No. AP002536.

Hainey, C.F., et al., "Maize Mapping Project/ DuPont Consensus Sequences for Design of Overgo Probes", *Unpublished*, (2002), Accession No. AY109876.

Hainey, C.F., et al., "Maize Mapping Project/ DuPont Consensus Sequences for Design of Overgo Probes", *Unpublished*, (2002), Accession No. AY104406.

Mc Innes, R., et al., "Isolation and characterization of a cinnamoyl-CoA reductase gene from perennial ryegrass (Lolium perenne L.)", *J. Plant Physiol.*, (2002), Accession No. AY061888.

Hainey, C.F., et al., "Maize Mapping Project/ DuPont Consensus Sequences for Design of Overgo Probes", *Unpublished*, (2002), Accession No. AY103989.

Larsen, K., "Cinnamoyl CoA reductase from barley", *Unpublished*, (2002), Accession No. AY149607.

Mc Innes, R., et al., "Isolation and characterization of a cinnamoyl-CoA reductase gene from perennial ryegrass (Lolium perenne L.)", *J. Plant Physiol.*, (2002), Accession No. AY061889.

Hainey, C.F., et al., "Maize Mapping Project/ DuPont Consensus Sequences for Design of Overgo Probes", *Unpublished*, (2002), Accession No. AY106966.

Hainey, C.F., et al., "Maize Mapping Project/ DuPont Consensus Sequences for Design of Overgo Probes", *Unpublished*, (2002), Accession No. AY105108.

Pichon, M., et al., "Cloning and characterization of two maize cDNAs encoding cinnamoyl-CoA reductase (CCR) and differential expression of the corresponding genes", *Plant Mol. Biol.*, 38 (4), 671-676, (1998), Accession No. X98083.

Civardi, L., et al., "Molecular cloning and characterization of cDNAs encoding cinnamyl alcohol dehydrogenase and cinnamoyl CoA reductase from maize", *Unpublished*, (1997), Accession No. Y13734.

Civardi, L., et al., "Molecular cloning and characterization of cDNAs encoding cinnamyl alcohol dehydrogenase and cinnamoyl CoA reductase from maize", *Unpublished*, (1997), Accession No. Y13733.

Bernhardt, J., et al., "Molecular analysis of a second functional A1 gene (dihydroflavonol 4-reductase) in Zea mays", *The Plant Journal*, 1998, pp. 483-488, vol. 14(4).

Fox, T.W., et al., "Zea Mays dihydro-flavanoid reductase-like protein (ms*-bs7) mRNA, complete cds", *NCBI Database*, (2001), Accession No. AF366295.

Zhuang, C.X., et al., "Differential expression of a putative dihydroflavonol reductase gene in rice (Accession No. AF134807) (PGR 99-074)", *NCBI Database*, (1999), Accession No. AF134807.

Hillier, L., et al., "The WashU-Merck EST Project", *NCBI Database*, (1995), Accession No. AA022571.

Bernhardt, J., et al., "Molecular analysis of a second functional A1 gene (dihydroflavonol 4-reductase) in Zea mays", *NCBI Database*, (1997), Accession No. CAA75998.

Bernhardt, J., et al., "Molecular analysis of a second functional A1 gene", *NCBI Database*, (1997), Accession No. CAA75996.

Bentley, S.D., et al., "Complete genome sequence of the model actinomycete Streptomyces coelicolor A3 (2)", *NCBI Database*, (2002), Accession No. NP_624490.

Marra, M., et al., "The WashU-HHMI Mouse EST Project", *NCBI Database*, (1996), Accession No. AA060212.

Marra, M., et al., "The WashU-HHMI Mouse EST Project", *NCBI Database*, (1996), Accession No. AA050084.

Marra, M., et al., "The WashU-HHMI Mouse EST Project", *NCBI Database*, (1996), Accession No. AA060214.

Marra, M., et al., "The WashU-HHMI Mouse EST Project", *NCBI Database*, (1996), Accession No. AA060213.

Hillier, L., et al., "Generation and analysis of 280,000 human expressed sequence tags", *NCBI Database*, (1996), Accession No. AA053552.

Li, W. and Gill, B.S., "The colinearity of the sh2/a1 orthologous region in rice, sorghum and maize is interrupted and accompanied by genome expansion in the triticeae", *NCBI Database*, (2001), Accession No. AF434703.

Sasaki, T., et al., "Oryza sativa nipponbare (GA3) genomic DNA, chromosome 8, PAC clone:P0686C03", *EMBL/GenBank/DDBJ Database*, (2003), Accession No. Q84Z61.

Kaneko, T., et al., "Structural analysis of Arabidopsis thaliana chromosome 5. XI.", *EMBL/GenBank/DDBJ database*, (2003), Accession No. Q9FGH3.

Zhuang, C.X., et al., "Differential expression of a putative dihydroflavonol reductase gene in rice (Accession No. AF134807) (PGR 99-074)", *EMBL/GenBank/DDBJ Database*, (2002), Accession No. Q9XHC8.

Fox, T.W., et al., "Dihydro-flavanoid reductase-like protein", *EMBL/GenBank/DDBJ databases*, (2001), Accession No. Q94KE6.

Li, W. and Gill, B.S., "Colinearity of the Sh2/A1 region among rice, sorghum and maize Is interrupted and accompanied by genome expansion in the Triticeae", *EMBL/GenBank/DDBJ Database*, (2002), Accession No. Q8W564.

Kristiansen, K.N. and Rohde, W., "Structure of the Hordeum vulgare gene encoding dihydroflavonol-4- reductase and molecular analysis of ant18 mutants blocked in flavonoid synthesis", *EMBL/GenBank/DDBJ Database*, (2003), Accession No. DFRA_HORVU.

Kristiansen, K.N. and Rohde, W., "Structure of the Hordeum vulgare gene encoding dihydroflavonol-4-reductase and molecular analysis of ant18 mutants blocked in flavonoid synthesis", *EMBL/GenBank/DDBJ Database*, (1991), Accession No. S69616.

Bernhardt, J., et al., "Molecular analysis of a second functional A1 gene (dihydroflavonol4-reductase) in Zea mays", *NCBI Database*, (1997), Accession No. Y16042.

Guo, Dianjing, et al., "Downregulation of Caffeic Acid 3-O Methyltransferase amd Caffepu; CpA 3-O-Methyltransferase in Transgenic Alfalfa: Impacts on Lignin Structure and Implications for the Biosynthesis of G and S Lignin," The Plant Cell, Jan. 2001, vol. 13, 73-88.

Chavez-Barcenas, Ana T., et al., "Tissue-Specific and Developmental Pattern of Expression of the Rice *sps*1 Gene", Plant Physiology, Oct. 2000, vol. 124, pp. 641-653.

LaPorte, Marianne M., "Promoter strength and tissue specificity effects on growth of tomato plants transmformed with maize sucrose-phosphate Synthase," Planta (2001) 212: 817-822.

Pilon-Smits, Elizabeth, A.H., et al., "Improved Performance of Transgenic Fructan-Accumulating Tobacco under Drought Stress," Plant Physiol., (1955) 107: 125-130.

Lunn, John E., et al., "Purification, molecular cloning, and sequence analysis of sucrose-6'—phosphate phosphohydrolase from plants," PNAS, Nov. 7, 2000, 12914-12919, vol. 96, No. 23.

Sebkova, Veronika, et al., "Biochemical, Physiological, and Molecular Characterization of Sucrose Synthase from *Daucus carota*," Plant Physiol., (1995) 108: 75-83.

Sturm, Arnd, "Invertases. Primary Structures, Functions, and Roles in Plant Development and Sucrose Partitioning," Plant Physiology, Sep. 1999, pp. 1-7, vol. 121.

Vijn, Irma, et al., "Fructan: More Than a Reserve Carbohydrate?" Plant Physiology, Jun. 1999, pp. 351-359, vol. 120.

Johnson, Eric T., et al., "Alteration of a single amino acid changes the substrate specificity of dihydroflavonol 4-reductase," The Plant Journal, (2001) 25(3), 325-333.

Mol, Joseph, et al., "How genes paint flowers and seeds," trends in plant science, Jun. 1998, pp. 212-217, vol. 3, No. 6.

Dixon, Richard A., et al., "Flavonoids and isoflavonoids—a gold mine for metabolic engineering," trends in plant science, Oct. 1999, pp. 394-400, vol. 4, No. 10.

Robbins, M.P., et al., "Metabolic Engineering of Condensed Tannins and Other Phenolic Pathways in Forage and Fodder Crops," Metabolic engineering of plant secondary metabolism, 2000, pp. 165-1777, Kluwer Academic Publishers, The Netherlands.

Luscher, Marcel, et al., "Cloning and Functional Analysis of Sucrose:Sucrose 1-Fructosyltransferase from Tall Fescue," Plant Physiology, Nov. 2000, pp. 1217-1227, vol. 124.

\* cited by examiner

COMPOSITIONS ISOLATED FROM FORAGE GRASSES AND METHODS FOR THEIR USE

REFERENCE TO RELATED APPLICATIONS

This application claims priority to U.S. Provisional Patent Application No. 60/337,703 filed Nov. 7, 2001.

TECHNICAL FIELD OF THE INVENTION

This invention relates to polynucleotides isolated from forage grass tissues, specifically from *Lolium perenne* (perennial ryegrass) and *Festuca arundinacea* (tall fescue), as well as oligonucleotide probes and primers, genetic constructs comprising the polynucleotides, biological materials (including host cells and plants) incorporating the polynucleotides, polypeptides encoded by the polynucleotides, and methods for using the polynucleotides and polypeptides. More particularly, the invention relates to polypeptides involved in the lignin, tannin and fructan biosynthetic pathways, and to polynucleotides encoding such polypeptides.

BACKGROUND OF THE INVENTION

Over the past 50 years, there have been substantial improvements in the genetic production potential of ruminant animals (sheep, cattle and deer). Levels of meat, milk or fiber production that equal an animal's genetic potential may be attained within controlled feeding systems, where animals are fully fed with energy dense, conserved forages and grains. However, the majority of temperate farming systems worldwide rely on the in situ grazing of pastures. Nutritional constraints associated with temperate pastures can prevent the full expression of an animal's genetic potential. This is illustrated by a comparison between milk production by North American grain-fed dairy cows and New Zealand pasture-fed cattle. North American dairy cattle produce, on average, twice the milk volume of New Zealand cattle, yet the genetic base is similar within both systems (New Zealand Dairy Board and United States Department of Agriculture figures). Significant potential therefore exists to improve the efficiency of conversion of pasture nutrients to animal products through the correction of nutritional constraints associated with pastures.

Lignin Biosynthetic Pathway

Lignin is an insoluble polymer that serves as a matrix around the polysaccharide components of some plant cell walls, and that is primarily responsible for the rigidity of plant stems. Generally, the higher the lignin content, the more rigid the plant. For example, tree species synthesize large quantities of lignin, with lignin constituting 20%–30% of the dry weight of wood. The lignin content of grasses ranges from 2–8% of dry weight and changes during the growing season. In addition to providing rigidity, lignin aids in water transport within plants by rendering cell walls hydrophobic and water impermeable. Lignin also plays a role in disease resistance of plants by impeding the penetration and propagation of pathogenic agents.

Forage digestibility is affected by both lignin composition and concentration. Lignin is largely responsible for the digestibility, or lack thereof, of forage crops, with small increases in plant lignin content resulting in relatively high decreases (>10%) in digestibility (Buxton and Russell, *Crop. Sci.* 28:5358–558, 1988). For example, crops with reduced lignin content provide more efficient forage for cattle, with the yield of milk and meat being higher relative to the amount of forage crop consumed. During normal plant growth, an increase in the maturity of the plant stem is accompanied by a corresponding increase in lignin content and composition that causes a decrease in digestibility. This change in lignin composition is to one of increasing syringyl:guaiacyl (S:G) ratio. When deciding on the optimum time to harvest forage crops, farmers must therefore choose between a high yield of less digestible material and a lower yield of more digestible material.

Lignin is formed by polymerization of three different monolignols, para-coumaryl alcohol, coniferyl alcohol and sinapyl alcohol that are synthesized in a multistep pathway, with each step in the pathway being catalyzed by a different enzyme. The three monolignols are derived from phenylalanine or tyrosine in a multistep process and are then polymerized into lignin by a free radical mechanism. Following polymerization, para-coumaryl alcohol, coniferyl alcohol and sinapyl alcohol are converted into the p-hydroxyphenyl (H), guaiacyl (G) and syringyl (S) units of lignin, respectively. While these three types of lignin subunits are well known, it is likely that slightly different variants of these subunits may be involved in the lignin biosynthetic pathway in various plants. For example, studies suggest that both free monolignols and monolignol-4-coumarate esters may be substrates for lignin formation in grasses. The relative concentration of the monolignol residues in lignin varies among different plant species and within species. For example, the monolignol content for H/G/S of grasses, alfalfa and softwood gymnosperms is 22%/44%/34%, 7%/39%/54% and 14%/80%/6%, respectively (van Soest in "Nutritional Ecology of the Ruminant," Cornell University Press, Ithaca, N.Y.). The composition of lignin may also vary among different tissues within a specific plant.

Coniferyl alcohol, para-coumaryl alcohol and sinapyl alcohol are synthesized by similar pathways (Whetten et al., *Annu. Rev. Plant Physiol. Plant Mol. Biol.* 49:585–609, 1998; Guo et al., *Plant Cell* 13:73–88, 2001). The first step in the lignin biosynthetic pathway is the deamination of phenylalanine or tyrosine by phenylalanine ammonia-lyase (PAL) or tyrosine ammonia-lyase (TAL), respectively. In maize, the PAL enzyme also has TAL activity (Rosler et al., *Plant Physiol.* 113:175–179, 1997). The product of TAL activity on tyrosine is 4-coumarate, whereas the product of PAL activity on phenylalanine is cinnamate which is then hydroxylated by cinnamate 4-hydroxylase (C4H) to form 4-coumarate. 4-Coumarate is hydroxylated by coumarate 3-hydroxylase (C3H) to give caffeate. The newly added hydroxyl group is then methylated by caffeic acid O-methyl transferase (COMT) to give ferulate. Several other methylation reactions can be catalyzed by COMT, including caffeoylaldehyde to coniferaldehyde, and 5-hydroxyconiferaldehyde to sinapaldehyde. 4-Coumarate, caffeate and ferulate can all be conjugated to coenzyme A by 4-coumarate: CoA ligase (4CL) to form 4-coumaryl CoA, caffeoyl CoA and feruloyl CoA, respectively. Caffeoyl CoA can then be methylated by the enzyme caffeoyl-CoA O-methyl transferase (CAMT).

Coniferaldehyde is hydroxylated to 5-hydroxyconiferaldehyde by ferulate 5-hydroxylase (F5H). Reduction of 4-coumaryl CoA, caffeoyl CoA and feruloyl-CoA to 4-coumaraldehyde, caffeoyl aldehyde and coniferaldehyde, respectively, is catalyzed by cinnamoyl-CoA reductase (CCR). Coumaraldehyde, caffeoyl aldehyde, coniferaldehyde and 5-hydroxyconfieraldehyde are further reduced by the action of cinnamyl alcohol dehydrogenase (CAD) to give coniferyl alcohol which is then converted into its glucosylated form for export from the cytoplasm to the cell wall by coniferol glucosyl transferase (CGT). Recently a sinapyl alcohol dehydrogenase (SAD) was described that converts sinapaldehyde to sinapyl alcohol (Li et al., *Plant Cell* 13:1567–1586, 2001). Following export, the de-glucosylated form of coniferyl alcohol is obtained by the action of coniferin beta-gulcosidase (CBG). Finally, polymerization of the three monolignols to provide lignin is catalyzed by phenolase (PNL), laccase (LAC) and peroxidase (PER). For a more detailed review of the lignin biosynthetic pathway, see Whetton R and Sederoff R, *The Plant Cell,* 7:1001–1013, 1995 and Whetten et al., *Annu. Rev. Plant Physiol. Plant Mol. Biol.* 49:585–609, 1998.

Both lignin levels and composition have been changed in a range of plant species by altering the expression of specific lignin biosynthetic enzymes. For example, anti-sense 4CL constructs in transgenic aspen trees reduced lignin content from 20 to 11% (a 45% reduction) but at the same time increased both cellulose levels (by 15%) and growth rate (Hu et al. *Nature Biotechnol.* 17:808–812, 1999). These trees had the same level of total carbon, suggesting that carbon partitioning had been altered. Reducing 4CL by either anti-sense or sense-suppression in tobacco plants led to an accumulation of hydroxycinnamic acids in cell walls as well as a reduction in both guaiacyl and syringyl lignin units (Kajita et al., *Plant Cell. Physiol.* 37:957–965, 1996). In transgenic tobacco plants in which levels of C4H were reduced by anti-sense or sense suppression, total lignin content was reduced, in addition to a reduction in syringyl lignin units (Sewalt et al., *Plant Physiol.* 115:41–50, 1997). Reducing the levels of PAL in tobacco plants by anti-sense or sense-suppression reduced total lignin content but did not change the syringyl-guaiacyl (S:G) lignin ration. In alfalfa, reducing expression of COMT through either anti-sense or gene silencing decreased total lignin by decreasing the amount of guaiacyl units and resulted in a near total loss of syringyl lignin units (Guo et al., *Plant Cell* 13:73–88, 2001). In contrast, reducing CCOMT expression through anti-sense or gene silencing in alfalfa plants also decreased total lignin by reducing the total amount of guaiacyl lignin units but had no effect on the amount of syringyl lignin. Reducing CCR expression by anti-sense in tobacco plants resulted in reduced lignin content and increased S:G ratios due to lower guaiacyl lignin units (Piquemal et al., *Plant J.* 13:71–83, 1998). *A. thaliana* plants where the F5H gene had been mutated contained only traces of syringyl lignin (Marita et al., *Proc. Natl. Acad. Sci. USA* 96:12323–12332, 1999).

Alteration of grass lignin composition may usefully be employed to maintain high forage digestibility throughout the year. This is most important when the plant is approaching flowering and/or during flowering. At this time, the entire lignin biosynthetic pathway will preferably be reduced, in particular lowering the amount of syringyl lignin units, thereby lowering the S:G ratio and maintaining the digestibility of the forage crop.

Several of the enzymes involved in the lignin biosynthetic pathway also have other functions within the plant. For example, PAL is a key enzyme of plant and fungi phenylpropanoid metabolism and catalyzes the first step in phenylpropanoid metabolism. It is involved in the biosynthesis of a wide variety of secondary metabolites such as flavonoids, furanocoumar in phytoalexins and cell wall components. These compounds have many important roles in plants during normal growth and in responses to environmental stress. PAL catalyzes the removal of an ammonia group from phenylalanine to form trans-cinnamate. PAL and the related histidine ammonia lyase are unique enzymes which are known to have the modified amino acid dehydroalanine (DHA) in their active site (Taylor et al., *J. Biol. Chem.* 265:18192–18199, 1990). Phenylalanine and histidine ammonia-lyases (PAL) active site has a consensus of GTITASGDLVPLSYIA (SEQ ID NO: 219). The serine residue is central to the active site, and the region around this active site residue is well conserved (Langer et al., *Biochem.* 33:6462–6467, 1994).

C4H, which is a member of the cytochrome P450 monooxygenase superfamily, plays a central role in both phenylpropanoid metabolism and lignin biosynthesis where it anchors a phenylpropanoid enzyme complex to the endoplasmic reticulum (ER). The phenylpropanoid pathway controls the synthesis of lignin, flower pigments, signaling molecules, and a large spectrum of compounds involved in plant defense against pathogens and UV light. This is also a branch point between general phenylpropanoid metabolism and pathways leading to various specific end products. 4 CLs are a group of enzymes necessary for maintaining a continuous metabolic flux for the biosynthesis of plant phenylpropanoids, such as lignin and flavonoids that are essential to the survival of plants, because they serve important functions in plant growth and adaptation to environmental perturbations. Three isoforms of 4CL have been identified with distinct substrate preference and specificities. Expression studies in angiosperms revealed a differential behavior of the three genes in various plant organs and upon external stimuli such as wounding and UV irradiation or upon challenge with fungi. One isoform is likely to participate in the biosynthetic pathway leading to flavonoids whereas the other two are probably involved in lignin formation and in the production of additional phenolic compounds other than flavonoids (Ehlting et al., *Plant J.* 19:9–20, 1999).

F5H is involved in the phenylpropanoid biosynthesis pathway. It belongs to the CYP84 subfamily of the cytochrome P450 family and is known as cytochrome P450 84A1. F5H is one of the enzymes in the pathways leading to the synthesis of sinapic acid esters, but also has coniferaldehyde hydroxylase activity (Nair et al., *Plant Physiol.* 123:1623–1634, 2000). In the generalized pathway for phenylpropanoid metabolism, F5H catalyzes the formation of 5-hydoxyferulate (a precursor of sinapate) and sinapate in turn as the precursor for sinapine and for sinapoyl CoA in two bifurcated pathways (Chapple et al., *Plant Cell* 4:1413–1424, 1992). Sinapoyl CoA has been considered as the precursor for sinapyl alcohol, which is then polymerized into syringyl (S) lignin. In addition, CYP84 F5H product carries out the hydroxylation of coniferaldehyde (ConAld) to 5-OH ConAld (Nair et al., *Plant Physiol.* 123:1623–1634, 2000).

Peroxidases are heme-containing enzymes that use hydrogen peroxide as the electron acceptor to catalyze a number of oxidative reactions. They belong to a superfamily consisting of 3 major classes. Class III consists of the secretory plant peroxidases, which have multiple tissue-specific functions in removal of hydrogen peroxide from chloroplasts and cytosol, oxidation of toxic compounds, biosynthesis of the cell wall, defense responses towards wounding, indole-3-acetic acid (IAA) catabolism and ethylene biosynthesis.

Fructan Biosynthetic Pathway

Plant carbohydrates can be divided into two groups depending on their function within the plant. Structural carbohydrates, such as cellulose, are usually part of the extracellular matrix. Non-structural, storage carbohydrates act as either long- or short-term carbohydrate stores. Examples of non-structural carbohydrates include starch, sucrose and fructans.

Fructans are polymers that are stored in the vacuole and that consist of linear and branched chains of fructose units (for review, see Vijn and Smeekens *Plant Physiol.* 120: 351–359, 1999). They play an important role in assimilate partitioning and possibly in stress tolerance in many plant families. Grasses use fructans instead of starch as a water-soluble carbohydrate store (Pollock et al., in "Regulation of primary metabolic pathways in plants", N. J. Kruger et al., (eds), Kluwer Academic Publishers, The Netherlands, pp195–226, 1999). Increasing the amount of fructans and sucrose in forage crops leads to an increase in the level of water-soluble carbohydrates and thereby enhances the nutritional value of the plants. In addition, increasing the amount of fructans in forage plants decreases m ethane production in animals fed the plants, thereby leading to lower greenhouse gas emissions, and decreases urea production in animals as less protein is degraded in the rumen (Biggs and Hancock, *Trends in Plant Sci.* 6:8–9, 2001). Fructans have also been implicated in protecting plants against water deficits caused by drought or low temperatures. Introduction of enzymes involved in the fructan biosynthetic pathway into plants that do not naturally synthesize fructans may be employed to confer cold tolerance and drought tolerance (Pilon-Smits, *Plant Physiol.* 107:125–130, 1995).

The number of fructose units within a fructan chain is referred to as the degree of polymerization (DP). In grasses, fructans of DP 6–10 are common. Such fructans of low DP are naturally sweet and are therefore of interest for use as sweeteners in foodstuffs. Long fructan chains form emulsions with a fat-like texture and a neutral taste. The human digestive system is unable to degrade fructans, and fructans of high D P may therefore be used as low-calorie food ingredients. Over-expression of enzymes involved in the fructan biosynthetic pathway may be usefully employed to produce quantities of fructans that can be purified for human consumption.

Five major classes of structurally different fructans have been identified in plants, with each class showing a different linkage of the fructosyl residues. Fructans found in grasses are of the mixed levan class, consisting of both (2-1)- and (2-6)-linked beta-D-fructosyl units (Pollock et al., in "Regulation of primary metabolic pathways in plants", N. J. Kruger et al., (eds), Kluwer Academic Publishers, The Netherlands, pp195–226, 1999). Fructans are synthesized by the action of fructosyltransferase enzymes on sucrose in the vacuole. These enzymes are closely related to invertases, enzymes that normally hydrolyze sucrose.

Grasses use two fructosyltransferase enzymes to synthesize fructans, namely sucrose:sucrose 1-fructosyltransferase (1-SST) and sucrose:fructan 6-fructosyltransferase (6-SFT) (Pollock et al., in "Regulation of primary metabolic pathways in plants", N. J. Kruger et al., (eds), Kluwer Academic Publishers, The Netherlands, pp195–226, 1999). 1-SST is a key enzyme in plant fructan biosynthesis, while 6-SFT catalyzes the formation and extension of beta-2,6-linked fructans that is typically found in grasses. Specifically, 1-SST catalyzes the formation of 1-kestose plus glucose from sucrose, while 6-SFT catalyzes the formation of bifurcose plus glucose from sucrose plus 1-kestose and also the formation of 6-kestose plus glucose from sucrose. Both enzymes can modify 1-kestose, 6-kestose and bifurcose further by adding additional fructose molecules. Over-expression of both 1-SST and 6-SFT in the same plant may be employed to produce fructans for use in human foodstuffs (Sevenier et al., *Nature Biotechnol* 16:843–846; Hellwege et al., *Proc. Nat. Acad. Sci. USA* 97:8699–8704,2000).

The synthesis of sucrose from photosynthetic assimilates in plants, and therefore the availability of sucrose for use in fructan formation, is controlled, in part, by the enzymes sucrose phosphate synthase (SPS) and sucrose phosphate phosphatase (SPP). Sucrose plays an important role in plant growth and development, and is a major end product of photosynthesis. It also functions as a primary transport sugar and in some cases as a direct or indirect regulator of gene expression (for a review see Smeekens, *Curr. Opin. Plant Biol.* 1:230–234, 1998). SPS regulates the synthesis of sucrose by regulating carbon partitioning in the leaves of plants and therefore plays a major role as a limiting factor in the export of photoassimilates out of the leaf The activity of SPS is regulated by phosphorylation and moderated by concentration of metabolites and light (Huber et al., *Plant Physiol.* 95:291–297, 1991). Specifically, SPS catalyzes the transfer of glucose from UDP-glucose to fructose-6-phosphate, thereby forming sucrose-6-phosphate (Suc-6-P). Suc-6-P is then dephosphorylated by SPP to form sucrose (Lunn et al., *Proc. Natl. Acad. Sci. USA* 97:12914–12919, 2000). The enzymes SPS and SPP exist as a heterotetramer in the cytoplasm of mesophyll cells in leaves, with SPP functioning to regulate SPS activity. SPS is also important in ripening fruits, sprouting tubers and germinating seeds (Laporte et al., *Planta* 212:817–822, 2001).

Once in the vacuole, sucrose can be converted into fructan by fructosyltransferases as discussed above, or hydrolyzed into glucose and fructose by the hydrolase enzymes known as invertases (Sturm, *Plant Physiol.* 121:1–7, 1999). There are several different types of invertases, namely extracellular (cell wall), vacuolar (soluble acid) and cytoplasmic, with at least two isoforms of each type of invertase normally being found within a plant species. In addition to having different subcellular locations, the different types of invertases have different biochemical properties. For example, soluble and cell wall invertases operate at acidic pH, whereas cytoplasmic invertases work at a more neutral or alkaline pH. Invertases are believed to regulate the entry of sucrose into different utilization pathways (Grof and Campbell, *Aust. J. Plant Physiol.* 28:1–12, 2001). Reduced vacuolar or cytoplasmic invertase activity in sink tissues may increase the level of water-soluble carbohydrates in plants. Plants contain several isoforms of cell wall invertases (CWINV), which accumulate as insoluble proteins. CWINV plays an important role in phloem unloading and in stress response. It hydrolyzes terminal non-reducing beta-D-fructofuranoside residues in beta-D-fructo-furanosides.

Another enzyme that acts upon sucrose in plants is soluble sucrose synthase (SUS). Recent results indicate that SUS is localized in the cytosol, associated with the plasma membrane and the actin cytoskeleton. Phosphorylation of SUS is one of the factors controlling localization of the enzyme (Winter and Huber, *Crit. Rev. Biochem. Mol. Biol.* 35:253–89, 2000). It catalyzes the transfer of glucose from sucrose to UDP, yielding UDP-glucose and fructose. Increasing the amount of SUS in a plant increases the amount of cellulose synthesis, whereas decreasing SUS activity should increase fructan levels. Increased SUS concentration may also increase the yield of fruiting bodies. SUS activity is highest in carbon sink tissues in plants and low in photosynthetic source tissues, and studies have indicated that SUS is the main sucrose-cleaving activity in sink tissues. Grasses have two isoforms of SUS that are encoded by separate genes. These genes are differentially expressed in different tissues.

Tannin Biosynthetic Pathway

Condensed tannins are polymerized flavonoids. More specifically, tannins are composed of catechin 4-ol and catechin monomer units, and are stored in the vacuole. In many temperate forage crops, such as ryegrass and fescue, foliar tissues are tannin-negative. This leads to a high initial rate of fermentation when these crops are consumed by ruminant livestock, resulting in both protein degradation and production of ammonia by the livestock. These effects can be reduced by the presence of low to moderate levels of tannin. In certain other plant species, the presence of high levels of tannins reduces palatability and nutritive value. Introduction of genes encoding enzymes involved in the biosynthesis of condensed tannins into a plant may be employed to synthesize flavonoid compounds that are not normally made in the plant. These compounds may then be isolated and used for treating human or animal disorders or as food additives.

Much of the biosynthetic pathway for condensed tannins is shared with that for anthocyanins, which are pigments responsible for flower color. Therefore, modulation of the levels of enzymes involved in the tannin biosynthetic pathway may be employed to alter the color of foliage and the pigments produced in flowers.

Most tannins described to date contain pro-cyanidin units derived from dihydroquercetin and pro-delphinidin units derived from dihydromyricetin. However, some tannins contain pro-pelargonidin units derived from dihydrokaempferol. The initial step in the tannin biosynthetic pathway is the condensation of coumaryl CoA with malonyl CoA to give naringenin-chalcone, which is catalyzed by the enzyme chalcone synthase (CHS). The enzyme chalcone isomerase (CHI) catalyzes the isomerization of naringenin chalcone to naringenin (also known as flavanone), which is then hydroxylated by the action of the enzyme flavonone 3-beta-hydroxylase (F3βH) to give dihydrokaempferol. The enzyme flavonoid 3'-hydroxylase (F3'OH) catalyzes the conversion of dihydrokaempferol to dihydroquercetin, which in turn can be converted into dihydromyricetin by the action of flavonoid 3'5'-hydroxylase (F3'5'OH). The enzyme dihydroflavonol-4-reductase (DFR) catalyzes the last step before dihydrokaempferol, dihydroquercetin and dihydromyricetin are committed for either anthocyanin (flower pigment) or proanthocyanidin (condensed tannin) formation. DFR also converts dihydrokaempferol to afzelchin-4-ol, dihydroquercetin to catechin-4-ol, and dihydromyricetin to gallocatechin-4-ol, probably by the action of more than one isoform. For a review of the tannin biosynthetic pathway, see, Robbins M. P. and Morris P. in Metabolic Engineering of Plant Secondary Metabolism, Verpoorte and Alfermann (eds), Kluwer Academic Publishers, the Netherlands, 2000.

While polynucleotides encoding some of the enzymes involved in the lignin, fructan and tannin biosynthetic pathways have been isolated for certain species of plants, genes encoding many of the enzymes in a wide range of plant species have not yet been identified. Thus there remains a need in the art for materials useful in the modification of lignin, fructan and tannin content and composition in plants, and for methods for their use.

SUMMARY OF THE INVENTION

The present invention provides enzymes involved in the lignin, fructan or tannin biosynthetic pathways that are encoded by polynucleotides isolated from forage grass tissues. The polynucleotides were isolated from *Lolium perenne* (perennial ryegrass) and *Festuca arundinacea* (tall fescue) tissues taken at different times of the year, specifically in winter and spring, and from different parts of the plants, including: leaf blades, leaf base, pseudostems, floral stems, roots, inflorescences and stems. The present invention also provides genetic constructs, expression vectors and host cells comprising the inventive polynucleotides, and methods for using the inventive polynucleotides and genetic constructs to modulate the biosynthesis of lignins, fructans and tannins.

In specific embodiments, the isolated polynucleotides of the present invention comprise a sequence selected from the group consisting of: (a) SEQ ID NO: 1–62 and 125–162; (b) complements of SEQ ID NO: 1–62 and 125–162; (c) reverse complements of SEQ ID NO: 1–62 and 125–162; (d) reverse sequences of SEQ ID NO: 1–62 and 125–162; (e) sequences having a 99% probability of being functionally or evolutionarily related to a sequence of (a)-(d), determined as described below; and (f) sequences having at least 75%, 80%, 90% or 98% identity to a sequence of (a)–(d), the percentage identity being determined as described below. Polynucleotides comprising at least a specified number of contiguous residues ("x-mers") of any of SEQ ID NO: 1–62 and 125–162; and oligonucleotide probes and primers corresponding to SEQ ID NO: 1–62 and 125–162 are also provided. All of the above polynucleotides are referred to herein as "polynucleotides of the present invention."

In further aspects, the present invention provides isolated polypeptides comprising an amino acid sequence of SEQ ID NO: 63–124 and 163–190, together with polypeptides comprising a sequence having at least 75%, 80%, 90% or 98% identity to a sequence of SEQ ID NO: 63–124 and 163–190, wherein the polypeptide possesses the same functional activity as the polypeptide comprising a sequence of SEQ ID NO: 63–124 and 163–190. The present invention also contemplates isolated polypeptides comprising at least a functional portion of a polypeptide comprising an amino acid sequence selected from the group consisting of: (a) SEQ ID NO: 63–124 and 163–190; and (b) sequences having at least 75%, 80%, 90% or 98% identity to a sequence of SEQ ID NO: 63–124 and 163–190.

In another aspect, the present invention provides genetic constructs comprising a polynucleotide of the present invention, either alone, in combination with one or more of the inventive sequences, or in combination with one or more known polynucleotides.

In certain embodiments, the present invention provides genetic constructs comprising, in the 5'–3' direction: a gene promoter sequence; an open reading frame coding for at least a functional portion of a polypeptide of the present invention; and a gene termination sequence. An open reading frame may be orientated in either a sense or anti-sense direction. Genetic constructs comprising a non-coding region of a polynucleotide of the present invention or a polynucleotide sequence complementary to a non-coding region, together with a gene promoter sequence and a gene termination sequence, are also provided. Preferably, the gene promoter and termination sequences are functional in a host cell, such as a plant cell. Most preferably, the gene promoter and termination sequences are those of the original enzyme genes but others generally used in the art, such as the Cauliflower Mosaic Virus (CMV) promoter, with or without enhancers, such as the Kozak sequence or Omega enhancer, and *Agrobacterium tumefaciens* nopalin synthase terminator may be usefully employed in the present invention. Tissue-specific promoters may be employed in order to target expression to one or more desired tissues. The construct may further include a marker for the identification of transformed cells.

In a further aspect, transgenic cells, such as transgenic plant cells, comprising the constructs of the present invention are provided, together with tissues and plants comprising such transgenic cells, and fruits, seeds and other products, derivatives, or progeny of such plants.

In yet another aspect, methods for modulating the lignin, fructan or tannin content and composition of a target organism, such as a plant, are provided, such methods including stably incorporating into the genome of the target plant a genetic construct comprising a polynucleotide of the present invention. In a preferred embodiment, the target plant is a forage grass, preferably selected from the group consisting of *Lolium* and *Festuca* species, and most preferably from the group consisting of *Lolium perenne* and *Festuca arundinacea*. In a related aspect, a method for producing a plant having altered lignin, fructan or tannin composition is provided, the method comprising transforming a plant cell with a genetic construct comprising of the present invention to provide a transgenic cell, and cultivating the transgenic cell under conditions conducive to regeneration and mature plant growth.

In yet a further aspect, the present invention provides methods for modifying the activity of an enzyme in a target organism, such as a plant, comprising stably incorporating into the genome of the target organism a genetic construct of the present invention. In a preferred embodiment, the target plant is a forage grass, preferably selected from the group consisting of *Lolium* and *Festuca* species, and most preferably from the group consisting of *Lolium perenne* and *Festuca arundinacea*.

DETAILED DESCRIPTION OF THE INVENTION

Figure 1:
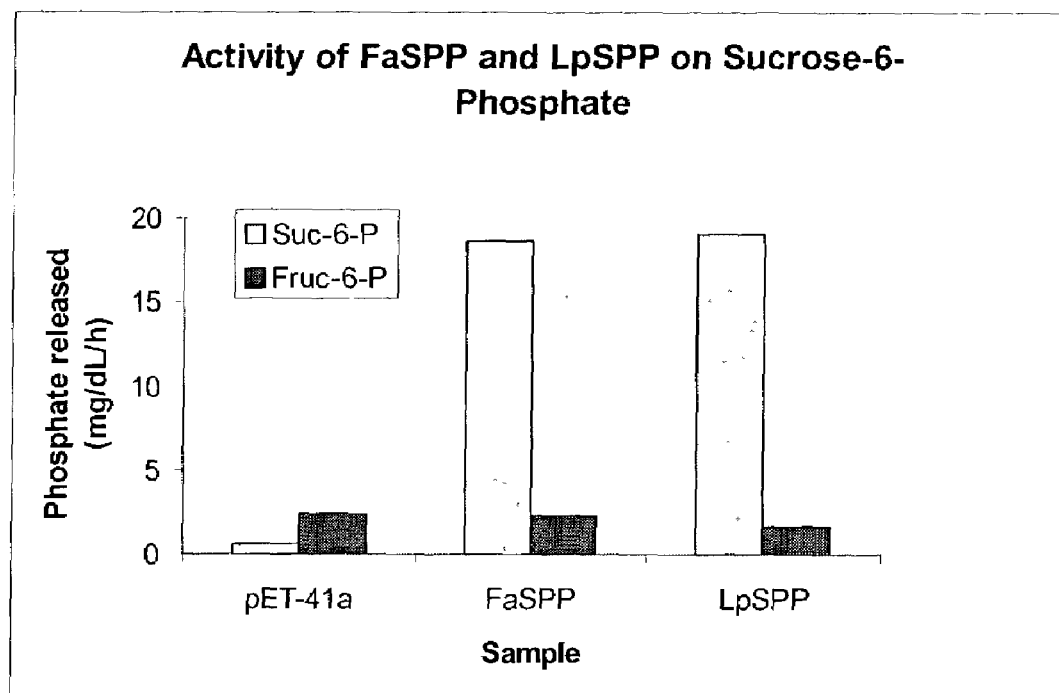
FIG. 1 shows the activity of recombinant LpSPP (SEQ ID NO: 8) and FaSPP (SEQ ID NO 7) on dephosphorylating Suc-6-P and Fru-6-P. The pET41a extract was the vector control.

The polypeptides of the present invention, and the polynucleotides encoding the polypeptides, have activity in lignin, fructan and tannin biosynthetic pathways in plants. Using the methods and materials of the present invention, the lignin, fructan and/or tannin content of a plant may be modulated by modulating expression of polynucleotides of the present invention, or by modifying the polynucleotides or polypeptides encoded by polynucleotides. The isolated polynucleotides and polypeptides of the present invention may thus be usefully employed in the correction of nutritional imbalances associated with temperate pastures and to increase the yield of animal products from pastures.

The lignin, fructan and/or tannin content of a target organism, such as a plant, may be modified, for example, by incorporating additional copies of genes encoding enzymes involved in the lignin, fructan or tannin biosynthetic pathways into the genome of the target plant. Similarly, a modified lignin, fructan and/or tannin content can be obtained by transforming the target plant with anti-sense copies of such genes. In addition, the number of copies of genes encoding for different enzymes in the lignin, fructan and tannin biosynthetic pathways can be manipulated to modify the relative amount of each monomer unit synthesized, thereby leading to the formation of lignins, fructans or tannins having altered composition.

The present invention thus provides methods for modulating the polynucleotide and/or polypeptide content and composition of an organism, such methods involving stably incorporating into the genome of the organism a genetic construct comprising one or more polynucleotides of the present invention. In one embodiment, the target organism is a plant species, preferably a forage plant, more preferably a grass of the *Lolium* or *Festuca* species, and most preferably *Lolium perenne* or *Festuca arundinacea*. In related aspects, methods for producing a plant having an altered genotype or phenotype is provided, such methods comprising transforming a plant cell with a genetic construct of the present invention to provide a transgenic cell, and cultivating the transgenic cell under conditions conducive to regeneration and mature plant growth. Plants having an altered genotype or phenotype as a consequence of modulation of the level or content of a polynucleotide or polypeptide of the present invention compared to a wild-type organism, as well as components (seeds, etc.) of such plants, and the progeny of such plants, are contemplated by and encompassed within the present invention.

The isolated polynucleotides of the present invention have utility in genome mapping, in physical mapping, and in positional cloning of genes. Additionally, the polynucleotide sequences identified as SEQ ID NOS: 1–62 and 125–162 and their variants, may be used to design oligonucleotide probes and primers. Oligonucleotide probes and primers have sequences that are substantially complementary to the polynucleotide of interest over a certain portion of the polynucleotide. Oligonucleotide probes designed using the polynucleotides of the present invention may be employed to detect the presence and examine the expression patterns of genes in any organism having sufficiently similar DNA and RNA sequences in their cells using techniques that are well known in the art, such as slot blot DNA hybridization techniques. Oligonucleotide primers designed using the polynucleotides of the present invention may be used for PCR amplifications. Oligonucleotide probes and primers designed using the polynucleotides of the present invention may also be used in connection with various microarray technologies, including the microarray technology of Affymetrix (Santa Clara, Calif.).

In a first aspect, the present invention provides isolated polynucleotide sequences identified in the attached Sequence Listing as SEQ ID NO: 1–62 and 125–162, and polypeptide sequences identified in the attached Sequence Listing as SEQ ID NO: 63–124 and 163–190. The polynucleotides and polypeptides of the present invention have demonstrated similarity to the following polypeptides that are known to be involved in lignin, fructan and tannin biosynthetic processes:

TABLE 1

| SEQ ID NO Polynucleotide | SEQ ID NO Polypeptide | Category | Description |
|---|---|---|---|
| 1 and 125 | 63 and 163 | Fructan biosynthesis | Homolog of Sucrose: Sucrose 1-fructosyl-transferase (1-SST) isolated from *Festuca arundinacea*. They contain a typical signature of the glycosyl hydrolases family 32 (amino acid residues 120 to 133). The glycosyl hydrolases family 32 domain signature has a consensus of HYQPxxH/NxxNDPNG, where D is the active site residue (Henrissat, Biochem. J. 280:309–316, 1991). |
| 2 | 64 | Fructan biosynthesis | Homolog of Sucrose: Sucrose 1-fructosyl-transferase (1-SST) isolated from *Festuca arundinacea*. It contains a typical signature of the glycosyl hydrolases family 32 (amino acid residues 120 to 133). The glycosyl hydrolases family 32 domain signature has a consensus of HYQPxxH/NxxNDPNG, where D is the active site residue (Henrissat, Biochem. J. 280:309–316, 1991). |
| 3 and 126 | 65 and 164 | Fructan biosynthesis | Homolog of Sucrose: fructan 6-fructosyl-transferase (6-SFT) isolated from *Festuca arundinacea*. They contain a typical signature of the glycosyl hydrolases family 32 (amino acid reidues 90 to 564). The glycosyl hydrolases family 32 domain signature has a consensus of HYQPxxH/NxxNDPNG, where D is the active site residue (Henrissat, Biochem. J 280:309–316, 1991). |
| 4 and 127 | 66 and 165 | Fructan biosynthesis | Homolog of Sucrose: fructan 6-fructosyl-transferase (6-SFT) isolated from *Lolium perenne*. They contain a typical signature of the glycosyl hydrolases family 32 (amino acid residues 96 to 107). The glycosyl hydrolases family 32 domain signature has a consensus of HYQPxxH/NxxNDPNG, where D is the active site residue (Henrissat, Biochem. J. 280:309–316, 1991). |
| 5 | 67 | Fructan biosynthesis | Homolog of sucrose: fructan 6-fructosyl-transferase (6-SFT) isolated from *Festuca arundinacea*. |
| 6 and 128 | 68 and 166 | Fructan biosynthesis | Homolog of Sucrose: fructan 6-fructosyl-transferase (6-SFT) isolated from *Lolium perenne*. They contain a typical signature of the glycosyl hydrolases family 32 (amino acid residues 90 to 103). The glycosyl hydrolases family 32 domain signature has a consensus of HYQPxxH/NxxNDPNG, where D is the active site residue (Henrissat, Biochem. J. 280:309–316, 1991). |

TABLE 1-continued

| SEQ ID NO Polynucleotide | SEQ ID NO Polypeptide | Category | Description |
|---|---|---|---|
| 7 and 129 | 69 | Fructan biosynthesis | Homolog of Sucrose-6-phosphate phospho-hydrolase (SPP; EC 3.1.3.24) isolated from *Festuca arundinacea*. This enzyme belongs to the superfamily of hydrolases, and has the three conserved motifs found in these proteins (Galperin and Koonin, Trends Biochem Sci. 23:127–129, 1998). Motif I (amino acid residues 10 to 19) contains conserved Asp and a Thr residues, motif II (amino acid residues 48 to 53) contains a conserved Thr residue, and Motif III (residues 167 to 220) contains conserved Lys (position 167) and Asp residues (position 202 and 206). These conserved amino acid residues are required for activity of the enzyme. |
| 8 | 70 | Fructan biosynthesis | Homolog of Sucrose-6-phosphate phospho-hydrolase (SPP; EC 3.1.3.24) isolated from *Lolium perenne*. This enzyme belongs to the superfamily of hydrolases, and has the three conserved motifs found in these proteins (Galperin and Koonin, Trends Biochem Sci. 23:127–129, 1998). Motif I (residues 10 to 19) contains conserved Asp and Thr residues, motif II (amino acid residues 48 to 53) contains a conserved Thr residue, and Motif III (amino acid residues 167 to 220) contains conserved Lys (position 167) and Asp residues (position 202 and 206). These conserved amino acid residues are required for activity of the enzyme. |
| 9 and 130 | 71 | Fructan biosynthesis | Homolog of sucrose phosphate synthase (SPS-1) isolated from *Festuca arundinacea*. |
| 10 and 131 | 72 and 167 | Fructan biosynthesis | Homolog of sucrose phosphate synthase (SPS-1) isolated from *Lolium perenne* and that is involved in the sucrose synthesis pathway. |
| 11 and 132 | 73 and 168 | Fructan biosynthesis | Homolog of sucrose phosphate synthase (SPS-N) isolated from *Lolium perenne* and that is involved in the sucrose synthesis pathway. |
| 12 and 133 | 74 and 169 | Fructan biosynthesis | Homolog of sucrose synthase (SuS) isolated from *Lolium perenne*. These molecules contain a leucine zipper motif in amino acid position 191 to 213. Leucine zipper motifs are present in many gene regulatory proteins (Landschulz et al., Science 240:1759–1764, 1988). |
| 13 | 75 | Fructan biosynthesis | Homolog of sucrose synthase (SuS) isolated from *Festuca arundinacea*. This molecule contains a leucine zipper motif in amino acid position 191 to 213. Leucine zipper motifs are present in many gene regulatory proteins (Landschulz et al., Science 240:1759–1764, 1988). |
| 14 and 134 | 76 and 170 | Fructan biosynthesis | Homolog of sucrose synthase (SuS) isolated from *Lolium perenne*. |
| 15 | 77 | Fructan biosynthesis | Homolog of sucrose synthase (SuS) isolated from *Festuca arundinacea*. |

TABLE 1-continued

| SEQ ID NO Polynucleotide | SEQ ID NO Polypeptide | Category | Description |
| --- | --- | --- | --- |
| 16 and 135 | 78 and 171 | Fructan biosynthesis | Homologue of cell wall invertase (CWINV) isolated from *Festuca arundinacea* that belongs to the family 32 of glycosyl hydrolases. These molecules contain a conserved peptide domain in amino acid residues 139 to 144 and 242–247, respectively. The consensus peptide domain of invertases is (WVYL)EC(PIL)D(LFI) with the conserved Cys residue part of the catalytic domain (Sturm, Plant Physiol. 121:1–7, 1999). |
| 17 | 79 | Fructan biosynthesis | Homolog of cell wall invertase (CWINV) isolated from *Lolium perenne* that belongs to the family 32 of glycosyl hydrolases. This molecule contains a conserved pentapeptide bF-motif at amino acid residues 70 to 74 and a peptide domain in amino acid residues 250 to 255. The consensus peptide domain of invertases is (WVYL)EC(PIL)D(LFI) with the conserved Cys residue part of the catalytic domain (Sturm, Plant Physiol. 121:1–7, 1999). It also contains a glycosyl hydrolases family 32 signature region at amino acids 61 to 74 that contains a conserved His residue important in the catalytic reaction (Reddy and Maley, J. Biol. Chem. 265:10817–10120, 1990). |
| 18 and 136 | 80 and 172 | Fructan biosynthesis | Homolog of cell wall invertase (CWINV) isolated from *Lolium perenne* that belongs to the family 32 of glycosyl hydrolases. |
| 19 | 81 | Fructan biosynthesis | Homolog of cell wall invertase (CWINV) isolated from *Festuca arundinacea* that belongs to the family 32 of glycosyl hydrolases. This molecule contains a conserved pentapeptide bF-motif at amino acid residues 60 to 64. The consensus peptide domain of invertases is (WVYL)EC(PIL)D(LFI) with the conserved Cys residue part of the catalytic domain (Sturm, Plant Physiol. 121:1–7, 1999). It also contains a glycosyl hydrolases family 32 signature region at amino acids 51 to 64 that contains a conserved His residue important in the catalytic reaction (Reddy and Maley, J. Biol. Chem. 265:10817–10120, 1990). A signal peptide is present in amino acid residues 1 to 24. |
| 20 and 137 | 82 and 173 | Fructan biosynthesis | Homolog of cell wall invertase (CWINV) isolated from *Festuca arundinacea* that belongs to the family 32 of glycosyl hydrolases. These molecules contain a peptide domain in amino acid residues 61 to 66 and 242–247, respectively. The consensus peptide domain of invertases is (WVYL)EC(PIL)D(LFI) with the conserved Cys residue part of the catalytic domain (Sturm, Plant Physiol. 121:1–7, 1999). |

TABLE 1-continued

| SEQ ID NO Polynucleotide | SEQ ID NO Polypeptide | Category | Description |
| --- | --- | --- | --- |
| 21 | 83 | Fructan biosynthesis | Homolog of cell wall invertase (CWINV) isolated from *Festuca arundinacea* that belongs to the family 32 of glycosyl hydrolases. This molecule contains a conserved pentapeptide bF-motif at amino acid residues 73 to 77 and a peptide domain in amino acid residues 253 to 258. The consensus peptide domain of invertases is (WVYL)EC(PIL)D-(LFI) with the conserved Cys residue part of the catalytic domain (Sturm, Plant Physiol. 121:1–7, 1999). It also contains a glycosyl hydrolases family 32 signature region at amino acid 64 to 77 that contains a conserved His residue important in the catalytic reaction (Reddy and Maley, J. Biol. Chem. 265:10817-10120, 1990). |
| 22 and 138 | 84 and 174 | Fructan biosynthesis | Homolog of cell wall invertase (CWINV) isolated from *Lolium perenne* that belongs to the family 32 of glycosyl hydrolases. These molecules contain a peptide domain in amino acid residues 174 to 179 and 234 to 239, respectively. The consensus peptide domain of invertases is (WVYL)EC-(PIL)D(LFI) with the conserved Cys residue part of the catalytic domain (Sturm, Plant Physiol. 121:1–7, 1999). |
| 23 | 85 | Fructan biosynthesis | Homolog of cell wall invertase (CWINV) isolated from *Festuca arundinacea* that belongs to the family 32 of glycosyl hydrolases. This molecule contains a conserved pentapeptide bF-motif at amino acid residues 56 to 60. The consensus peptide domain of invertases is (WVYL)EC(PIL)D(LFI) with the conserved Cys residue part of the catalytic domain (Sturm, Plant Physiol. 121:1–7, 1999). It also contains a glycosyl hydrolases family 32 signature region at amino acid 47 to 60 that contains a conserved His residue that is important in the catalytic reaction (Reddy and Maley, J. Biol. Chem. 265:10817-10120, 1990). A signal peptide is present in amino acid residues 1 to 22. |
| 24 and 139 | 86 and 175 | Fructan biosynthesis | Homolog of cell wall invertase (CWINV) isolated from *Lolium perenne* that belongs to the family 32 of glycosyl hydrolases. These molecules contain a conserved pentapeptide bF-motif at amino acid residues 244 to 249. The consensus peptide domain of invertases is (WVYL)EC(PIL)D(LFI) with the conserved Cys residue part of the catalytic domain (Sturm, Plant Physiol. 121:1–7, 1999). They also contain a glycosyl hydrolases family 32 signature region at amino acid 56 to 69 that contains a conserved His residue that is important in the catalytic reaction (Reddy and Maley, J. Biol. Chem. 265:10817-10120, 1990). A signal peptide is present in amino acid residues 1 to 25. |

TABLE 1-continued

| SEQ ID NO Polynucleotide | SEQ ID NO Polypeptide | Category | Description |
|---|---|---|---|
| 25 and 140 | 87 and 176 | Fructan biosynthesis | Homolog of vacuolar invertase (SINV) isolated from *Lolium perenne* that belongs to the family 32 of glycosyl hydrolases. These molecules contain a conserved pentapeptide bF-motif at amino acid residues 136 to 140 and 138 to 142, respectively and a peptide domain in amino acid residues 317 to 322 and 319 to 324, respectively. The consensus peptide domain of invertases is (WVYL)EC(PIL)D(LFI) with the conserved Cys residue part of the catalytic domain (Sturm, Plant Physiol. 121:1–7, 1999). It also contains a glycosyl hydrolases family 32 signature region at amino acid 127 to 140 and 129 to 142 that contains a conserved His residue that is important in the catalytic reaction (Reddy and Maley, J. Biol. Chem. 265:10817-10120, 1990). |
| 26 and 141 | 88 and 177 | Fructan biosynthesis | Homolog of invertase (SINV) isolated from *Lolium perenne* that belongs to the family 32 of glycosyl hydrolases. These molecules contain a peptide domain in amino acid residues 143 to 148 and 184 to 189, respectively. The consensus peptide domain of invertases is (WVYL)EC(PIL)D(LFI) with the conserved Cys residue part of the catalytic domain (Sturm, Plant Physiol. 121:1–7, 1999). |
| 27 | 89 | Lignin/Tannin biosynthesis | Homolog of 4-Coumarate: CoA ligase (4CL, EC 6.2.1.12) isolated from *Lolium perenne* The molecule has two conserved AMP binding regions at amino acid residues 182 to 193 and 383 to 389 (Hu et al., Proc. Natl. Acad. Sci. USA 95:5407–5412, 1998). The AMP-binding domain signature consists of two binding site motifs. The consensus of the first motif is LPYSSGTTGLPK (Etchegaray et al., Biochem. Mol. Biol. Int. 44:235–243, 1998). The region very rich in glycine, serine, and threonine followed by a conserved lysine. In most of these proteins, the residue that follows the Lys at the end of the pattern is a Gly. The second motif consensus sequence is GEIC(V/I)RG(Hu et al., Proc. Natl. Acad. Sci. USA 95:5407–5412, 1998). |
| 28 and 142 | 90 | Lignin/Tannin biosynthesis | Homolog of 4-Coumarate: CoA ligase (4CL, EC 6.2.1.12) isolated from *Lolium perenne*. The molecule has two conserved AMP binding regions at amino acid residues 195 to 206 and 395 to 401 (Hu et al., Proc. Natl. Acad. Sci. USA 95:5407–5412, 1998). The AMP-binding domain signature consists of two binding site motifs. The consensus of the first motif is LPYSSGTTGLPK (Etchegaray et al., Biochem. Mol. Biol. Int. 44:235–243, 1998). The region very rich in glycine, serine, and theonine followed by a conserved lysine. In |

TABLE 1-continued

| SEQ ID NO Polynucleotide | SEQ ID NO Polypeptide | Category | Description |
|---|---|---|---|
| | | | most of these proteins, the residue that follows the Lys at the end of the pattern is a Gly. The second motif consensus sequence is GEIC(V/I)RG (Hu et al., Proc. Natl. Acad. Sci. USA 95:5407–5412, 1998). |
| 29 | 91 | Lignin/Tannin biosynthesis | Homolog of 4-Coumarate:CoA ligase (4CL, EC 6.2.1.12) isolated from *Festuca arundinacea*. The molecule has two conserved AMP binding regions at amino acid residues 195 to 206 and 395 to 401 (Hu et al., Proc. Natl. Acad. Sci. USA 95:5407–5412, 1998). The AMP-binding domain signature consists of two binding site motifs. The consensus of the first motif is LPYSSGTTGLPK (Etchegaray et al., Biochem. Mol. Biol. Int. 44:235–243, 1998). The region very rich in glycine, serine, and threonine followed by a conserved lysine. In most of these proteins, the residue that follows the Lys at the end of the pattern is a Gly. The second motif consensus sequence is GEIC(V/I)RG (Hu et al., Proc. Natl. Acad. Sci. USA 95:5407–54 12, 1998). |
| 30 and 143 | 92 and 178 | Lignin/Tannin biosynthesis | Homolog of 4-Coumarate:CoA ligase (4CL, EC 6.2.1.12) isolated from *Lolium*. The molecules have two conserved AMP binding regions at amino acid residues 194 to 205 and 394 to 400 (Hu et al., Proc. Natl. Acad. Sci. USA 95:5407–5412, 1998). The AMP-binding domain signature consists of two binding site motifs. The consensus of the first motif is LPYSSGTTGLPK (Etchegaray et al., Biochem. Mol. Biol. Int. 44:235–243, 1998). The region very rich in glycine, serine, and threonine followed by a conserved lysine. In most of these proteins, the residue that follows the Lys at the end of the pattern is a Gly. The second motif consensus sequence is GEIC(V/I)RG (Hu et al., Proc. Natl. Acad. Sci. USA 95:5407–5412, 1998). |
| 31 | 93 | Lignin/Tannin biosynthesis | Homolog of 4-Coumarate:CoA ligase (4CL, EC 6.2.1.12) isolated from *Festuca arundinacea*. The molecule has two conserved AMP binding regions at amino acid residues 194 to 206 and 482 to 490 (Hu et al., Proc. Natl. Acad. Sci. USA 95:5407–5412, 1998). The AMP-binding domain signature consists of two binding site motifs. The consensus of the first motif is LPYSSGTTGLPK (Etchegaray et al., Biochem. Mol. Biol. Int. 44:235–243, 1998). The region very rich in glycine, serine, and threonine followed by a conserved lysine. In most of these proteins, the residue that follows the Lys at the end of the pattern is a Gly. The second motif consensus sequence is GEIC(V/I)RG (Hu et al., Proc. Natl. Acad. Sci. USA 95:5407–5412, 1998). |
| 32 and 144 | 94 and 179 | Lignin/Tannin biosynthesis | Homolog of cinnamic acid 4-hydroxylase (C4H) isolated from *Lolium perenne*. The molecules have a conserved cytochrome P450 region in amino acids 436 to 445 that contains a conserved Cys residue involved in heme binding (Miles et al., Biochim Biophys Acta 1543:383–407, 2000). |

TABLE 1-continued

| SEQ ID NO Polynucleotide | SEQ ID NO Polypeptide | Category | Description |
| --- | --- | --- | --- |
| 33 | 95 | Lignin/Tannin biosynthesis | Homolog of cinnamic acid 4-hydroxylase (C4H) isolated from *Festuca arundinacea*. The molecule has a conserved Cytochrome P450 region in amino acids 440 to 449 that contains a conserved Cys residue involved in heme binding. The cytochrome P450 cysteine heme-iron ligand signature consensus is FG × GRRSCPG where the conserved C is the heme iron ligand (Miles et al., Biochim. Biophys. Acta 1543:383–407, 2000). It also contains an aldehyde dehydrogenases active site (Hempel et al., Adv. Exp. Med. Biol. 436:53–59, 1999) at amino acid residues 428 to 435. A hydrophobic signal peptide region is present in amino acid residues 1 to 24. |
| 34 and 145 | 96 and 180 | Lignin biosynthesis | Homolog of cinnamyl-alcohol dehydrogenase (CAD; EC 1.1.1.195) isolated from *Lolium perenne*. These molecules contain a conserved zinc-containing alcohol dehydrogenase domain (Joernvall et al., Eur. J. Biochem. 167:195–201, 1987) in amino acid residues 69 to 83, with a conserved His residue at position 70. They also contain a cytochrome C family heme-binding site signature (Mathews, Prog. Biophys. Mol. Biol. 45:1–56, 1985) in residues 45 to 50. |
| 35 | 97 | Lignin biosynthesis | Homolog of cinnamyl-alcohol dehydrogenase (CAD; EC 1.1.1.195) isolated from *Festuca arundinacea*. CAD belongs to the family of zinc-binding dehydrogenases. This molecule contains a conserved zinc-containing alcohol dehydrogenases domain (Joernvall et al., Eur. J. Biochem. 167:195–201, 1987) in amino acid residues 69 to 83, with a conserved His residue at position 70. It also contains a Cytochrome C family heme-binding site signature. The cytochrome C family heme-binding site signature is CGICHT. In the cytochrome C protein family, the heme group is covalently attached by thioether bonds to two conserved cysteine residues. The consensus sequence for this site is Cys-X-X-Cys-His and the histidine residue is one of the two axial ligands of the heme iron. This arrangement is shared by all proteins known to belong to cytochrome C family (Mathews, Prog. Biophys. Mol. Biol. 45:1–56, 1985). |
| 36 and 146 | 98 | Lignin biosynthesis | Homolog of caffeoyl coenzyme A O-methyltransferase (CCoAOMT) (EC 2.1.1.104) isolated from *Lolium perenne*. |
| 37 | 99 | Lignin biosynthesis | Homolog of caffeoyl coenzyme A O-methyltransferase (CCoAOMT) (EC 2.1.1.104) isolated from *Festuca arundinacea*. |
| 38 and 147 | 100 and 181 | Lignin biosynthesis | Homolog of cinnamoyl CoA:NADP oxidoreductase (CCR, EC 1.2.1.44) isolated from *Lolium perenne* that catalyzes the conversion of cinnamoyl CoA esters to their corresponding cinnamaldehydes in the first specific step in the synthesis of the lignin monomers. A hydrophobic region typical of a signal peptide is present in amino acid residues 1 to 24. |
| 39 and 148 | 101 | Lignin biosynthesis | Homolog of cinnamoyl CoA:NADP oxidoreductase (CCR, EC 1.2.1.44) isolated from *Festuca arundinacea* that catalyzes the conversion of cinnamoyl CoA esters to their corresponding cinnamaldehydes in the first specific step in the synthesis of the lignin monomers. |

TABLE 1-continued

| SEQ ID NO Polynucleotide | SEQ ID NO Polypeptide | Category | Description |
|---|---|---|---|
| 40 and 149 | 102 and 182 | Lignin biosynthesis | Homolog of caffeic acid 3-O-methyltransferase (COMT1) isolated from *Festuca arundinacea* A conserved consensus phosphopantetheine attachment site was identified in amino acid residues 47 to 62. This domain is involved in the attachment of activated fatty acid and amino-acid groups, with the Ser residue at position 52 crucial for the phosphopantetheine attachment (Pugh and Wakil, J. Biol. Chem. 240:4727–4733, 1965). |
| 41 and 150 | 103 | Lignin biosynthesis | Homolog of caffeic acid 3-O-methyltransferase (COMT1) isolated from *Lolium perenne* A conserved consensus phosphopantetheine attachment site was identified in amino acid residues 47 to 62. This domain is involved in the attachment of activated fatty acid and amino-acid groups, with the Ser residue at position 52 crucial for the phosphopantetheine attachment (Pugh and Wakil, J. Biol. Chem. 240:4727–4733, 1965). |
| 42 | 104 | Lignin biosynthesis | Homolog of caffeic acid 3-O-methyltransferase (COMT1) isolated from *Festuca arundinacea* A conserved consensus phosphopantetheine attachment site was identified in amino acid residues 47 to 62. This domain is involved in the attachment of activated fatty acid and amino-acid groups, with the Ser residue at position 52 crucial for the phosphopantetheine attachment (Pugh and Wakil, J. Biol. Chem. 240:4727–4733, 1965). |
| 43 | 105 | Lignin biosynthesis | Homolog of caffeic acid 3-O-methyltransferase (COMT1) isolated from *Lolium perenne* A conserved consensus phosphopantetheine attachment site was identified in amino acid residues 47 to 62. This domain is involved in the attachment of activated fatty acid and amino-acid groups, with the Ser residue at position 52 crucial for the phosphopantetheine attachment (Pugh and Wakil, J. Biol. Chem. 240:4727–4733, 1965). |
| 44 and 151 | 106 and 183 | Lignin biosynthesis | Homolog of ferulate 5-hydroxylase (F5H) isolated from *Lolium perenne*. The molecules have a conserved cytochrome P450 region in amino acids 463 to 472 that contains a conserved Cys residue involved in heme binding (Miles et al., Biochim Biophys Acta 1543:383–407, 2000). A signal peptide is present in amino acid residues 1 to 30. |
| 45 | 107 | Lignin biosynthesis | Homolog of ferulate 5-hydroxylase (F5H) isolated from *Festuca arundinaceae*. The molecule has a conserved cytochrome P450 region in amino acids 462 to 471 that contains a conserved Cys residue involved in heme binding (Miles et al., Biochim Biophys Acta 1543:383–407, 2000). A signal peptide is present in amino acid residues 1 to 30. |
| 46 and 152 | 108 | Lignin/Tannin biosynthesis | Homolog of phenylalanine ammonia-lyase (EC 4.3.1.5) (PAL) isolated from *Lolium perenne*. The polypeptide has a conserved PAL-histidase region in amino acid residues 193 to 209. |
| 47 and 153 | 109 and 184 | Lignin/Tannin biosynthesis | Homolog of phenylalanine ammonia-lyase (EC 4.3.1.5) (PAL) isolated from *Festuca arundinacea*. A conserved phenylalanine and histidine ammonia-lyases active site signature has been identified in amino acid residues 195 to 210 |
| 48 | 110 | Lignin biosynthesis | Homolog of peroxidase (PER) isolated from *Festuca arundinacea*. The conserved peroxidase I region is present in amino acid residues 188 to 199 and contains a conserved His residue at position 196 in the active site, and the conserved peroxidase 2 region is present in amino acid residues 60 to 71, with a conserved His residue at |

TABLE 1-continued

| SEQ ID NO Polynucleotide | SEQ ID NO Polypeptide | Category | Description |
|---|---|---|---|
| 49 | 111 | Lignin biosynthesis | position 69 that is involved in heme binding (Kimura and Ikeda-Saito, Proteins 3:113–120, 1988). A signal peptide is present in amino acid residues 1 to 27. Homolog of peroxidase (PER) isolated from *Lolium perenne*. The conserved peroxidase I region is present in amino acid residues 199 to 209 and contains a conserved His residue at position 208 in the active site. A signal peptide is present in amino acid residues 1 to 33. |
| 50 | 112 | Lignin biosynthesis | Homolog of peroxidase (PER) isolated from *Festuca arundinacea*. The conserved peroxidase I region is present in amino acid residues 180 to 190 and contains a conserved His residue at position 188 in the active site, and the conserved peroxidase 2 region is present in amino acid residues 55 to 66, with a conserved His residue at position 64 that is involved in heme binding (Kimura and Ikeda-Saito, Proteins 3:113–120, 1988). A signal peptide is present in amino acid residues 1 to 22. |
| 51 and 154 | 113 | Lignin biosynthesis | Homolog of peroxidase (PER) isolated from *Lolium perenne*. The conserved peroxidase I region is present in amino acid residues 199 to 209 and contains a conserved His residue at position 207 in the active site, and the conserved peroxidase 2 region is present in amino acid residues 70 to 80, with a conserved His residue at position 78 that is involved in heme binding (Kimura and Ikeda-Saito, Proteins 3:113–120, 1988). A signal peptide is present in amino acid residues 1 to 20. |
| 52 and 155 | 114 | Lignin biosynthesis | Homolog of peroxidase (PER) isolated from *Lolium perenne*. The conserved peroxidase I region is present in amino acid residues 198 to 208 and contains a conserved His residue at position 206 in the active site (Kimura and Ikeda-Saito, Proteins 3:113–120, 1988). A signal peptide is present in amino acid residues 1 to 34. |
| 53, 156, and 162 | 115, 185, and 190 | Lignin biosynthesis | Homolog of peroxidase (PER) isolated from *Lolium perenne*. The conserved peroxidase I region is present in amino acid residues 157 to 168, 188 to 199, and 190 to 201, respectively and contain a conserved His residue at position 165, 196 and 198, respectively in the active site, and the conserved peroxidase 2 region is present in amino acid residues 29 to 41, 60 to 72 and 62 to 74, respectively, with a conserved His residue at position 38, 69 and 71, respectively that is involved in heme binding (Kimura and Ikeda-Saito, Proteins 3:113–120, 1988). |
| 54 | 116 | Lignin biosynthesis | Homolog of peroxidase (PER) isolated from *Festuca arundinacea*. The conserved peroxidase I region is present in amino acid residues 176 to 186 and contains a conserved His residue at position 184 in the active site, and the conserved peroxidase 2 region is present in amino acid residues 55 to 67, with a conserved His residue at position 64 that is involved in heme binding (Kimura and Ikeda-Saito, Proteins 3:113–120, 1988). A signal peptide is present in amino acid residues 1 to 22. |
| 55 | 117 | Tannin Biosynthesis | Homolog of chalcone isomerase (CHI) isolated from *Lolium perenne*. The molecule contains a chalcone isomerase region at amino acid residues 1 to 213. |

TABLE 1-continued

| SEQ ID NO Polynucleotide | SEQ ID NO Polypeptide | Category | Description |
|---|---|---|---|
| 56 | 118 | Tannin Biosynthesis | Homolog of chalcone isomerase (CHI). The molecule contains a chalcone isomerase region at amino acid residues 23 to 235. |
| 57 and 157 | 119 and 186 | Tannin Biosynthesis | Homolog of Chalcone Synthase (CHS) isolated from *Lolium perenne* and that is an important enzyme in flavonoid synthesis. The molecules contain a conserved chalcone synthase active site (Lanz et al., J. Biol. Chem. 266:9971–9976, 1991) at amino acid residues 166 to 175, with the conserved Cys residue at position 167. |
| 58 and 158 | 120 and 187 | Tannin Biosynthesis | Homolog of dihydroflavonal-4-reductase (DFR) isolated from *Festuca arundinacea*. |
| 59 and 159 | 121 and 188 | Tannin Biosynthesis | Homolog of dihydroflavonal-4-reductase (DFR) isolated from *Lolium perenne*. |
| 60 and 160 | 122 and 189 | Tannin Biosynthesis | Homolog of dihydroflavonal-4-reductase (DFR) isolated from *Lolium perenne*. These molecules contain a conserved ATP/GTP binding site at amino acid residues 84 to 91 and 86 to 93, respectively, known as the "A" sequence (Walker et al., EMBO J. 1:945–951, 1982) or "P-loop" (Saraste et al., Trends Biochem. Sd. 15:430–434, 1990). |
| 61 and 161 | 123 | Tannin biosynthesis | Homolog of flavanone 3-βhydroxylase (F3βH) isolated from *Lolium perenne*. |
| 62 | 124 | Tannin Biosynthesis | Homolog of flavanone 3-βhydroxylase (F3βH) isolated from *Festuca arundinacea*. |

All the polynucleotides and polypeptides provided by the present invention are isolated and purified, as those terms are commonly used in the art. Preferably, the polypeptides and polynucleotides are at least about 80% pure, more preferably at least about 90% pure, and most preferably at least about 99% pure.

The word "polynucleotide(s)," as used herein, means a polymeric collection of nucleotides, and includes DNA and corresponding RNA molecules and both single and double stranded molecules, including RNAi, HnRNA and mRNA molecules, sense and anti-sense strands of DNA and RNA molecules, and comprehends cDNA, genomic DNA, and wholly or partially synthesized polynucleotides. A polynucleotide of the present invention may be an entire gene, or any portion thereof. As used herein, a "gene" is a DNA sequence which codes for a functional protein or RNA molecule. Operable anti-sense polynucleotides may comprise a fragment of the corresponding polynucleotide, and the definition of "polynucleotide" therefore includes all operable anti-sense fragments. Anti-sense polynucleotides and techniques involving anti-sense polynucleotides are well known in the art and are described, for example, in Robinson-Benion et al., *Methods in Enzymol.* 254(23): 363–375, 1995 and Kawasaki et al., *Artific. Organs* 20(8): 836–848, 1996.

In specific embodiments, the present invention provides isolated polynucleotides comprising a sequence of SEQ ID NO: 1–62 and 125–162; polynucleotides comprising variants of SEQ ID NO: 1–62 and 125–162; polynucleotides comprising extended sequences of SEQ ID NO: 1–62 and 125–162 and their variants, oligonucleotide primers and probes corresponding to the sequences set out in SEQ ID NO: 1–62 and 125–162 and their variants, polynucleotides comprising at least a specified number of contiguous residues of any of SEQ ID NO: 1–62 and 125–162 (x-mers), and polynucleotides comprising extended sequences which include portions of the sequences set out in SEQ ID NO: 1–62 and 125–162, all of which are referred to herein, collectively, as "polynucleotides of the present invention." Polynucleotides that comprise complements of such polynucleotide sequences, reverse complements of such polynucleotide sequences, or reverse sequences of such polynucleotide sequences, together with variants of such sequences, are also provided.

The definition of the terms "complement(s)," "reverse complement(s)," and "reverse sequence(s)," as used herein, is best illustrated by the following example. For the sequence 5' AGGACC 3', the complement, reverse complement, and reverse sequence are as follows:

```
complement          3' TCCTGG 5'
reverse complement  3' GGTCCT 5'
reverse sequence    5' CCAGGA 3'.
```

Preferably, sequences that are complements of a specifically recited polynucleotide sequence are complementary over the entire length of the specific polynucleotide sequence.

As used herein, the term "x-mer," with reference to a specific value of "x," refers to a polynucleotide comprising at least a specified number ("x") of contiguous residues of: any of the polynucleotides provided in SEQ ID NO: 1–62 and 125–162. The value of x may be from about 20 to about 600, depending upon the specific sequence.

Polynucleotides of the present invention comprehend polynucleotides comprising at least a specified number of contiguous residues (x-mers) of any of the polynucleotides identified as SEQ ID NO: 1–62 and 125–162, or their variants. Similarly, polypeptides of the present invention comprehend polypeptides comprising at least a specified number of contiguous residues (x-mers) of any of the polypeptides identified as SEQ ID NO: 63–124 and 163–190. According to preferred embodiments, the value of x is at least 20, more preferably at least 40, more preferably yet at least 60, and most preferably at least 80. Thus, polynucleotides of the present invention include polynucleotides comprising a 20-mer, a 40-mer, a 60-mer, an 80-mer, a 100-mer, a 120-mer, a 150-mer, a 180-mer, a 220-mer, a 250-mer; or a 300-mer, 400-mer, 500-mer or 600-mer of a polynucleotide provided in SEQ ID NO: 1–62 and 125–162, or a variant of one of the polynucleotides corresponding to the polynucleotides provided in SEQ ID NO: 1–62 and 125–162. Polypeptides of the present invention include polypeptides comprising a 20-mer, a 40-mer, a 60-mer, an 80-mer, a 100-mer, a 120-mer, a 150-mer, a 180-mer, a 220-mer, a 250-mer; or a 300-mer, 400-mer, 500mer or 600-mer of a polypeptide provided in SEQ ID NO: 63–124 and 163–190, or a variant thereof.

Polynucleotides of the present invention were isolated by high throughput sequencing of cDNA libraries comprising forage grass tissue collected from *Lolium perenne* and *Festuca arundinacea*. Some of the polynucleotides of the present invention may be "partial" sequences, in that they do not represent a full-length gene encoding a full-length polypeptide. Such partial sequences may be extended by analyzing and sequencing various DNA libraries using primers and/or probes and well known hybridization and/or PCR techniques. Partial sequences may be extended until an open reading frame encoding a polypeptide, a full-length polynucleotide and/or gene capable of expressing a polypeptide, or another useful portion of the genome is identified. Such extended sequences, including full-length polynucleotides and genes, are described as "corresponding to" a sequence identified as one of the sequences of SEQ ID NO: 1–62 and 125–162 or a variant thereof, or a portion of one of the sequences of SEQ ID NO: 1–62 and 125–162 or a variant thereof, when the extended polynucleotide comprises an identified sequence or its variant, or an identified contiguous portion (x-mer) of one of the sequences of SEQ ID NOS: 1–62 and 125–162 or a variant thereof. Similarly, RNA sequences, reverse sequences, complementary sequences, anti-sense sequences and the like, corresponding to the polynucleotides of the present invention, may be routinely ascertained and obtained using the cDNA sequences identified as SEQ ID NOS: 1–62 and 125–162.

The polynucleotides identified as SEQ ID NOS: 1–62 and 125–162 contain open reading frames ("ORFs") or partial open reading frames encoding polypeptides and functional portions of polypeptides. Additionally, open reading frames encoding polypeptides may be identified in extended or full length sequences corresponding to the sequences set out as SEQ ID NOS: 1–62 and 125–162. Open reading frames may be identified using techniques that are well known in the art. These techniques include, for example, analysis for the location of known start and stop codons, most likely reading frame identification based on codon frequencies, etc. These techniques include, for example, analysis for the location of known start and stop codons, most likely reading frame identification based on codon frequencies, etc. Suitable tools and software for ORF analysis are well known in the art and include, for example, GeneWise, available from The Sanger Center, Wellcome Trust Genome Campus, Hinxton, Cambridge, CB10 1SA, United Kingdom; Diogenes, available from Computational Biology Centers, University of Minnesota, Academic Health Center, UMHG Box 43 Minneapolis Minn. 55455; and GRAIL, available from the Informatics Group, Oak Ridge National Laboratories, Oak Ridge, Tenn. Once a partial open reading frame is identified, the polynucleotide may be extended in the area of the partial open reading frame using techniques that are well known in the art until the polynucleotide for the full open reading frame is identified.

Once open reading frames are identified in the polynucleotides of the present invention, the open reading frames may be isolated and/or synthesized. Expressible genetic constructs comprising the open reading frames and suitable promoters, initiators, terminators, etc., which are well known in the art, may then be constructed. Such genetic constructs may be introduced into a host cell to express the polypeptide encoded by the open reading frame. Suitable host cells may include various prokaryotic and eukaryotic cells, including plant cells, mammalian cells, bacterial cells, algae and the like.

The polynucleotides of the present invention may be isolated by high throughput sequencing of cDNA libraries prepared from forage grass tissue, as described below in Example 1. Alternatively, oligonucleotide probes and primers based on the sequences provided in SEQ ID NOS: 1–62 and 125–162 can be synthesized as detailed below, and used to identify positive clones in either cDNA or genomic DNA libraries from forage grass tissue cells by means of hybridization or polymerase chain reaction (PCR) techniques. Hybridization and PCR techniques suitable for use with such oligonucleotide probes are well known in the art (see, for example, Mullis et al., *Cold Spring Harbor Symp. Quant. Biol.,* 51:263, 1987; Erlich, ed., *PCR technology*, Stockton Press: NY, 1989; and Sambrook et al., eds., *Molecular cloning: a laboratory manual,* 2nd ed., CSHL Press: Cold Spring Harbor, N.Y., 1989). In addition to DNA-DNA hybridization, DNA-RNA or RNA-RNA hybridization assays are also possible. In the first case, the mRNA from expressed genes would then be detected instead of genomic DNA or cDNA derived from mRNA of the sample. In the second case, RNA probes could be used. Artificial analogs of DNA hybridizing specifically to target sequences could also be employed. Positive clones may be analyzed by restriction enzyme digestion, DNA sequencing or the like.

The polynucleotides of the present invention may also, or alternatively, be synthesized using techniques that are well known in the art. The polynucleotides may be synthesized, for example, using automated oligonucleotide synthesizers (e.g., Beckman Oligo 1000M DNA Synthesizer; Beckman Coulter Ltd., Fullerton, Calif.) to obtain polynucleotide segments of up to 50 or more nucleic acids. A plurality of such polynucleotide segments may then be ligated using standard DNA manipulation techniques that are well known in the art of molecular biology. One conventional and exemplary polynucleotide synthesis technique involves synthesis of a single stranded polynucleotide segment having, for example, 80 nucleic acids, and hybridizing that segment to a synthesized complementary 85 nucleic acid segment to produce a 5 nucleotide overhang. The next segment may then be synthesized in a similar fashion, with a 5 nucleotide overhang on the opposite strand. The "sticky" ends ensure proper ligation when the two portions are hybridized. In this way, a complete polynucleotide of the present invention may be synthesized entirely in vitro.

Oligonucleotide probes and primers complementary to and/or corresponding to SEQ ID NOS: 1–62 and 125–162, and variants of those sequences, are also comprehended by the present invention. Such oligonucleotide probes and primers are substantially complementary to the polynucleotide of interest over a certain portion of the polynucleotide. An oligonucleotide probe or primer is described as "corresponding to" a polynucleotide of the present invention, including one of the sequences set out as SEQ ID NOS: 1–62 and 125–162 or a variant thereof, if the oligonucleotide probe or primer, or its complement, is contained within one of the sequences set out as SEQ ID NOS: 1–62 and 125–162 or a variant of one of the specified sequences.

Two single stranded sequences are said to be substantially complementary when the nucleotides of one strand, optimally aligned and compared, with the appropriate nucleotide insertions and/or deletions, pair with at least 80%, preferably at least 90% to 95%, and more preferably at least 98% to 100%, of the nucleotides of the other strand. Alternatively, substantial complementarity exists when a first DNA strand will selectively hybridize to a second DNA strand under stringent hybridization conditions.

In specific embodiments, the oligonucleotide probes and/or primers comprise at least about 6 contiguous residues, more preferably at least about 10 contiguous residues, and most preferably at least about 20 contiguous residues complementary to a polynucleotide sequence of the present invention. Probes and primers of the present invention may be from about 8 to 100 base pairs in length, preferably from about 10 to 50 base pairs in length, and more preferably from about 15 to 40 base pairs in length. The probes can be easily selected using procedures well known in the art, taking into account DNA-DNA hybridization stringencies, annealing and melting temperatures, potential for formation of loops, and other factors which are well known in the art. Preferred techniques for designing PCR primers are disclosed in Dieffenbach and Dyksler, *PCR Primer: a laboratory manual*, CSHL Press: Cold Spring Harbor, N.Y., 1995. A software program suitable for designing probes, and especially for designing PCR primers, is available from Premier Biosoft International, 3786 Corina Way, Palo Alto, Calif. 94303–4504.

The isolated polynucleotides of the present invention also have utility in genome mapping, in physical mapping, and in positional cloning of genes.

The polynucleotides identified as SEQ ID NOS: 1–62 and 125–162 were isolated from cDNA clones and represent sequences that are expressed in the tissue from which the cDNA was prepared. RNA sequences, reverse sequences, complementary sequences, anti-sense sequences, and the like, corresponding to the polynucleotides of the present invention, may be routinely ascertained and obtained using the cDNA sequences identified as SEQ ID NOS: 1–62 and 125–162.

Identification of genomic DNA and heterologous species DNA can be accomplished by standard DNA/DNA hybridization techniques, under appropriately stringent conditions, using all or part of a polynucleotide sequence as a probe to screen an appropriate library. Alternatively, PCR techniques using oligonucleotide primers that are designed based on known genomic DNA, cDNA and protein sequences can be used to amplify and identify genomic and cDNA sequences.

In another aspect, the present invention provides isolated polypeptides encoded by the above polynucleotides. As used herein, the term "polypeptide" encompasses amino acid chains of any length, including full-length proteins, wherein the amino acid residues are linked by covalent peptide bonds. The term "polypeptide encoded by a polynucleotide" as used herein, includes polypeptides encoded by a polynucleotide that comprises a partial isolated polynucleotide sequence provided herein. In specific embodiments, the inventive polypeptides comprise an amino acid sequence selected from the group consisting of SEQ ID NO: 63–124 and 163–190, as well as variants of such sequences.

As noted above, polypeptides of the present invention may be produced recombinantly by inserting a polynucleotide sequence of the present invention encoding the polypeptide into an expression vector and expressing the polypeptide in an appropriate host. Any of a variety of expression vectors known to those of ordinary skill in the art may be employed. Expression may be achieved in any appropriate host cell that has been transformed or transfected with an expression vector containing a polynucleotide molecule that encodes a recombinant polypeptide. Suitable host cells include prokaryotes, yeast, and higher eukaryotic cells. Preferably, the host cells employed are plant, *E. coli*, insect, yeast, or a mammalian cell line such as COS or 293T. The polynucleotide sequences expressed in this manner may encode naturally occurring polypeptides, portions of naturally occurring polypeptides, or other variants thereof. The expressed polypeptides may be used in various assays known in the art to determine their biological activity. Such polypeptides may also be used to raise antibodies, to isolate corresponding interacting proteins or other compounds, and to quantitatively determine levels of interacting proteins or other compounds.

In a related aspect, polypeptides are provided that comprise at least a functional portion of a polypeptide having an amino acid sequence selected from the group consisting of sequences provided in SEQ ID NO: 63–124 and 163–190, and variants thereof. As used herein, the "functional portion" of a polypeptide is that portion which contains an active site essential for affecting the function of the polypeptide, for example, a portion of the molecule that is capable of binding one or more reactants. The active site may be made up of separate portions present on one or more polypeptide chains and will generally exhibit high binding affinity. Functional portions of a polypeptide may be identified by first preparing fragments of the polypeptide by either chemical or enzymatic digestion of the polypeptide, or by mutation analysis of the polynucleotide that encodes the polypeptide and subsequent expression of the resulting mutant polypeptides. The polypeptide fragments or mutant polypeptides are then tested to determine which portions retain biological activity, using methods well known to those of skill in the art, including the representative assays described below.

Portions and other variants of the inventive polypeptides may be generated by synthetic or recombinant means. Synthetic polypeptides having fewer than about 100 amino acids, and generally fewer than about 50 amino acids, may be generated using techniques well known to those of ordinary skill in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2146, 1963. Equipment for automated synthesis of polypeptides is commercially available from suppliers such as Perkin Elmer/Applied Biosystems, Inc. (Foster City, Calif.), and may be operated according to the manufacturer's instructions. Variants of a native polypeptide may be prepared using standard mutagenesis techniques, such as oligonucleotide-directed site-specific mutagenesis (Kunkel, *Proc. Natl. Acad. Sci. USA* 82:488–492, 1985). Sections of DNA sequences may also be removed using standard techniques to permit preparation of truncated polypeptides.

As used herein, the term "variant" comprehends nucleotide or amino acid sequences different from the specifically identified sequences, wherein one or more nucleotides or amino acid residues is deleted, substituted, or added. Variants may be naturally occurring allelic variants, or non-naturally occurring variants. Variant sequences (polynucleotide or polypeptide) preferably exhibit at least 75%, more preferably at least 80%, more preferably at least 90%, more preferably yet at least 95% and most preferably, at least 98% identity to a sequence of the present invention. The percentage identity is determined by aligning the two sequences to be compared as described below, determining the number of identical residues in the aligned portion, dividing that number by the total number of residues in the inventive (queried) sequence, and multiplying the result by 100.

Polynucleotides and polypeptides having a specified percentage identity to a polynucleotide or polypeptide identified in one of SEQ ID NO: 1–190 thus share a high degree of similarity in their primary structure. In addition to a specified percentage identity to a polynucleotide or polypeptide of the present invention, variant polynucleotides and polypeptides preferably have additional structural and/or functional features in common with a polynucleotide of the present invention. Polynucleotides having a specified degree of identity to, or capable of hybridizing to, a polynucleotide of the present invention preferably additionally have at least one of the following features: (1) they contain an open reading frame, or partial open reading frame, encoding a polypeptide, or a functional portion of a polypeptide, having substantially the same functional properties as the polypeptide, or functional portion thereof, encoded by a polynucleotide in the recited SEQ ID NO:; or (2) they contain identifiable domains in common. Similarly, polypeptides having a specified degree of identity to a polypeptide of the present invention preferably additionally have at least one of the following features: (1) they have substantially the same functional properties as the polypeptide in the recited SEQ ID NO:; or (2) they contain identifiable domains in common.

Polynucleotide or polypeptide sequences may be aligned, and percentages of identical nucleotides or amino acids in a specified region may be determined against another polynucleotide or polypeptide, using computer algorithms that are publicly available. The BLASTN and FASTA algorithms, set to the default parameters described in the documentation and distributed with the algorithm, may be used for aligning and identifying the similarity of polynucleotide sequences. The alignment and similarity of polypeptide sequences may be examined using the BLASTP algorithm. BLASTX and FASTX algorithms compare nucleotide query sequences translated in all reading frames against polypeptide sequences. The FASTA and FASTX algorithms are described in Pearson and Lipman, *Proc. Natl. Acad. Sci. USA* 85:2444–2448, 1988; and in Pearson, *Methods in Enzymol.* 183:63–98, 1990. The FASTA software package is available from the University of Virginia by contacting the Assistant Provost for Research, University of Virginia, PO Box 9025, Charlottesville, Va. 22906-9025. The BLASTN software is available from the National Center for Biotechnology Information (NCBI), National Library of Medicine, Building 38A, Room 8N805, Bethesda, Md. 20894. The BLASTN algorithm Version 2.0.11 [Jan. 20, 2000] and Version 2.2.1 [Apr. 13, 2001] set to the default parameters described in the documentation and distributed with the algorithm, are preferred for use in the determination of polynucleotide variants according to the present invention. The use of the BLAST family of algorithms, including BLASTN, BLASTP and BLASTX, is described in the publication of Altschul et al., "Gapped BLAST and PSI-BLAST: a new generation of protein database search programs," *Nucleic Acids Res.* 25:3389–3402, 1997.

The following running parameters are preferred for determination of alignments and similarities using BLASTN that contribute to the E values and percentage identity for polynucleotides: Unix running command with the following default parameters: blastall -p blastn -d embldb -e 10 -G 0 -E 0 -r 1 -v 30 -b 30 -i queryseq -o results; and parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (BLASTN only) [Integer]; -v Number of one-line descriptions (V) [Integer]; -b Number of alignments to show (B) [Integer]; -i Query File [File In]; -o BLAST report Output File [File Out] Optional.

The following running parameters are preferred for determination of alignments and similarities using BLASTP that contribute to the E values and percentage identity of polypeptide sequences: blastall -p blastp -d swissprotdb -e 10 -G 0 -E 0 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional.

The "hits" to one or more database sequences by a queried sequence produced by BLASTN, BLASTP, FASTA, or a similar algorithm, align and identify similar portions of sequences. The hits are arranged in order of the degree of similarity and the length of sequence overlap. Hits to a database sequence generally represent an overlap over only a fraction of the sequence length of the queried sequence.

As noted above, the percentage identity of a polynucleotide or polypeptide sequence is determined by aligning polynucleotide and polypeptide sequences using appropriate algorithms, such as BLASTN or BLASTP, respectively, set to default parameters; identifying the number of identical nucleic or amino acids over the aligned portions; dividing the number of identical nucleic or amino acids by the total number of nucleic or amino acids of the polynucleotide or polypeptide of the present invention; and then multiplying by 100 to determine the percentage identity. By way of example, a queried polynucleotide having 220 nucleic acids has a hit to a polynucleotide sequence in the EMBL database having 520 nucleic acids over a stretch of 23 nucleotides in the alignment produced by the BLASTN algorithm using the default parameters. The 23-nucleotide hit includes 21 identical nucleotides, one gap and one different nucleotide. The percentage identity of the queried polynucleotide to the hit in the EMBL database is thus 21/220 times 100, or 9.5%. The percentage identity of polypeptide sequences may be determined in a similar fashion.

The BLASTN and BLASTX algorithms also produce "Expect" values for polynucleotide and polypeptide alignments. The Expect value (E) indicates the number of hits one can "expect" to see over a certain number of contiguous sequences by chance when searching a database of a certain size. The Expect value is used as a significance threshold for determining whether the hit to a database indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the sequences then have a probability of 90% of being related. For sequences having an E value of 0.01 or less over aligned and matched portions, the probability of finding a match by chance in the EMBL database is 1% or less using the BLASTN algorithm. E values for polypeptide sequences may be determined in a similar fashion using various polypeptide databases, such as the SwissProt database.

According to one embodiment, "variant" polynucleotides and polypeptides, with reference to each of the polynucleotides and polypeptides of the present invention, preferably comprise sequences having the same number or fewer nucleotides or amino acids than each of the polynucleotides or polypeptides of the present invention and producing an E value of 0.01 or less when compared to the polynucleotide or polypeptide of the present invention. That is, a variant polynucleotide or polypeptide is any sequence that has at least a 99% probability of being related to the polynucleotide or polypeptide of the present invention, measured as having an E value of 0.01 or less using the BLASTN or BLASTX algorithms set at the default parameters. According to a preferred embodiment, a variant polynucleotide is a sequence having the same number or fewer nucleic acids than a polynucleotide of the present invention that has at least a 99% probability of being related to the polynucleotide of the present invention, measured as having an E value of 0.01 or less using the BLASTN algorithm set at the default parameters. Similarly, according to a preferred embodiment, a variant polypeptide is a sequence having the same number or fewer amino acids than a polypeptide of the present invention that has at least a 99% probability of being related as the polypeptide of the present invention, measured as having an E value of 0.01 or less using the BLASTP algorithm set at the default parameters.

In an alternative embodiment, variant polynucleotides are sequences that hybridize to a polynucleotide of the present invention under stringent conditions. Stringent hybridization conditions for determining complementarity include salt conditions of less than about 1 M, more usually less than about 500 mM, and preferably less than about 200 mM. Hybridization temperatures can be as low as 5° C., but are generally greater than about 22° C., more preferably greater than about 30° C., and most preferably greater than about 37° C. Longer DNA fragments may require higher hybridization temperatures for specific hybridization. Since the stringency of hybridization may be affected by other factors such as probe composition, presence of organic solvents, and extent of base mismatching, the combination of parameters is more important than the absolute measure of any one alone. An example of "stringent conditions" is prewashing in a solution of 6×SSC, 0.2% SDS; hybridizing at 65° C., 6×SSC, 0.2% SDS overnight; followed by two washes of 30 minutes each in 1×SSC, 0.1% SDS at 65° C. and two washes of 30 minutes each in 0.2×SSC, 0.1% SDS at 65° C.

The present invention also encompasses polynucleotides that differ from the disclosed sequences but that, as a consequence of the discrepancy of the genetic code, encode a polypeptide having similar enzymatic activity to a polypeptide encoded by a polynucleotide of the present invention. Thus, polynucleotides comprising sequences that differ from the polynucleotide sequences recited in SEQ ID NO: 1–62 and 125–162, or complements, reverse sequences, or reverse complements of those sequences, as a result of conservative substitutions are contemplated by and encompassed within the present invention. Additionally, polynucleotides comprising sequences that differ from the polynucleotide sequences recited in SEQ ID NO: 1–62 and 125–162, or complements, reverse complements or reverse sequences thereof, as a result of deletions and/or insertions totaling less than 10% of the total sequence length are also contemplated by and encompassed within the present invention. Similarly, polypeptides comprising sequences that differ from the polypeptide sequences recited in SEQ ID NO: 63–124 and 163–190 as a result of amino acid substitutions, insertions, and/or deletions totaling less than 10% of the total sequence length are contemplated by and encompassed within the present invention, provided the variant polypeptide has activity in a lignin, fructan or tannin biosynthetic pathway.

In another aspect, the present invention provides genetic constructs comprising, in the 5'–3' direction, a gene promoter sequence; an open reading frame coding for at least a functional portion of a polypeptide of the present invention; and a gene termination sequence. The open reading frame may be orientated in either a sense or anti-sense direction. For applications where amplification of lignin, fructan or tannin synthesis is desired, the open reading frame may be inserted in the construct in a sense orientation, such that transformation of a target organism with the construct will lead to an increase in the number of copies of the gene and therefore an increase in the amount of enzyme. When down-regulation of lignin, fructan or tannin synthesis is desired, the open reading frame may be inserted in the construct in an anti-sense orientation, such that the RNA produced by transcription of the polynucleotide is complementary to the endogenous mRNA sequence. This, in turn, will result in a decrease in the number of copies of the gene and therefore a decrease in the amount of enzyme. Alternatively, regulation may be achieved by inserting appropriate sequences or subsequences (e.g., DNA or RNA) in ribozyme constructs.

Genetic constructs comprising a non-coding region of a gene coding for a polypeptide of the present invention, or a nucleotide sequence complementary to a non-coding region, together with a gene promoter sequence and a gene termination sequence, are also provided. As used herein the term "non-coding region" includes both transcribed sequences which are not translated, and non-transcribed sequences within about 2000 base pairs 5' or 3' of the translated sequences or open reading frames. Examples of non-coding regions which may be usefully employed in the inventive constructs include introns and 5'-non-coding leader sequences. Transformation of a target plant with such a genetic construct may lead to a reduction in the amount of lignin, fructan or tannin synthesized by the plant by the process of cosuppression, in a manner similar to that discussed, for example, by Napoli et al., *Plant Cell* 2:279–290, 1990; and de Carvalho Niebel et al., *Plant Cell* 7:347–358, 1995.

The genetic constructs of the present invention further comprise a gene promoter sequence and a gene termination sequence, operably linked to the polynucleotide to be transcribed, which control expression of the gene. The gene promoter sequence is generally positioned at the 5' end of the polynucleotide to be transcribed, and is employed to initiate transcription of the polynucleotide. Gene promoter sequences are generally found in the 5' non-coding region of a gene but they may exist in introns (Luehrsen, *Mol. Gen. Genet.* 225:81–93, 1991). When the construct includes an open reading frame in a sense orientation, the gene promoter sequence also initiates translation of the open reading frame. For genetic constructs comprising either an open reading frame in an anti-sense orientation or a non-coding region, the gene promoter sequence consists only of a transcription initiation site having a RNA polymerase binding site.

A variety of gene promoter sequences which may be usefully employed in the genetic constructs of the present invention are well known in the art. The promoter gene sequence, and also the gene termination sequence, may be endogenous to the target plant host or may be exogenous, provided the promoter is functional in the target host. For example, the promoter and termination sequences may be from other plant species, plant viruses, bacterial plasmids and the like. Preferably, gene promoter and termination sequences are from the inventive sequences themselves.

Factors influencing the choice of promoter include the desired tissue specificity of the construct, and the timing of transcription and translation. For example, constitutive promoters, such as the 35S Cauliflower Mosaic Virus (CaMV 35S) promoter, will affect the activity of the enzyme in all parts of the plant. Use of a tissue specific promoter will result in production of the desired sense or anti-sense RNA only in the tissue of interest. With DNA constructs employing inducible gene promoter sequences, the rate of RNA polymerase binding and initiation can be modulated by external stimuli, such as light, heat, anaerobic stress, alteration in nutrient conditions and the like. Temporally regulated promoters can be employed to effect modulation of the rate of RNA polymerase binding and initiation a t a specific time during development of a transformed cell. Preferably, the original promoters from the enzyme gene in question, or promoters from a specific tissue-targeted gene in the organism to be transformed, such as *Lolium* or *Festuca*, are used. Grass promoters different from the original gene may also be usefully employed in the inventive genetic constructs in order to prevent feedback inhibition. For example, the fructosyltransferase gene will be regulated by sucrose sensing systems; therefore removing the gene from under control of its normal promoter allows the gene to be active all the time. Other examples of gene promoters which may be usefully employed in the present invention include, mannopine synthase (mas), octopine synthase (ocs) and those reviewed by Chua et al., *Science* 244:174–181, 1989.

The gene termination sequence, which is located 3' to the polynucleotide to be transcribed, may come from the same gene as the gene promoter sequence or may be from a different gene. Many gene termination sequences known in the art may be usefully employed in the present invention, such as the 3' end of the *Agrobacterium tumefaciens* nopaline synthase gene. However, preferred gene terminator sequences are those from the original enzyme gene or from the target species to be transformed.

The genetic constructs of the present invention may also contain a selection marker that is effective in plant cells, to allow for the detection of transformed cells containing the inventive construct. Such markers, which are well known in the art, typically confer resistance to one or more toxins. One example of such a marker is the NPTII gene whose expression results in resistance to kanamycin or hygromycin, antibiotics which are usually toxic to plant cells at a moderate concentration (Rogers et al., in Weissbach A and H, eds., *Methods for Plant Molecular Biology*, Academic Press Inc.: San Diego, Calif., 1988). Alternatively, the presence of the desired construct in transformed cells can be determined by means of other techniques well known in the art, such as Southern and Western blots.

Techniques for operatively linking the components of the inventive genetic constructs are well known in the art and include the use of synthetic linkers containing one or more restriction endonuclease sites as described, for example, by Sambrook et al., (*Molecular cloning: a laboratory manual*, CSHL Press: Cold Spring Harbor, N.Y., 1989). The genetic construct of the present invention may be linked to a vector having at least one replication system, for example, *E. coli*, whereby after each manipulation, the resulting construct can be cloned and sequenced and the correctness of the manipulation determined.

The genetic constructs of the present invention may be used to transform a variety of plants, both monocotyledonous (e.g., grasses, maize/corn, grains, oats, rice, sorghum, millet, rye, sugar cane, wheat and barley), dicotyledonous (e.g., *Arabidopsis*, tobacco, legumes, alfalfa, oaks, eucalyptus, maple), and gymnosperms. In a preferred embodiment, the inventive genetic constructs are employed to transform grasses. Preferably the target plant is selected from the group consisting of *Lolium* and *Festuca* species, most preferably from the group consisting of *Lolium perenne* and *Festuca arundinacea*. Other plants that may be usefully transformed with the inventive genetic constructs include other species of ryegrass and fescue, including, but not limited to *Lolium multiflorum* (Italian ryegrass), *Lolium hybridum* (hybrid ryegrass), *Lolium rigidum* (Wimerra grass), *Lolium temulentum* (darnel), *Festuca rubra* (red fescue) and *Festuca pratensis* (meadow fescue). As discussed above, transformation of a plant with a genetic construct of the present invention will produce a modified lignin, fructan or tannin content in the plant.

The production of RNA in target cells may be controlled by choice of the promoter sequence, or by selecting the number of functional copies or the site of integration of the polynucleotides incorporated into the genome of the target organism. A target plant may be transformed with more than one construct of the present invention, thereby modulating the lignin, fructan and/or tannin biosynthetic pathways by affecting the activity of more than one enzyme, affecting enzyme activity in more than one tissue or affecting enzyme activity at more than one expression time. Similarly, a construct may be assembled containing more than one open reading frame coding for an enzyme encoded by a polynucleotide of the present invention or more than one noncoding region of a gene coding for such an enzyme. The polynucleotides of the present invention may also be employed in combination with other known sequences encoding enzymes involved in the lignin, fructan and/or tannin biosynthetic pathways. In this manner, more than one biosynthetic pathway may be modulated, or a lignin, fructan or tannin biosynthetic pathway may be added to a plant to produce a plant having an altered phenotype.

Techniques for stably incorporating genetic constructs into the genome of target plants are well known in the art and include *Agrobacterium tumefaciens* mediated introduction, electroporation, protoplast fusion, injection into reproductive organs, injection into immature embryos, high velocity projectile introduction and the like. The choice of technique will depend upon the target plant to be transformed. For example, dicotyledonous plants and certain monocots and gymnosperms may be transformed by *Agrobacterium* Ti plasmid technology, as described, for example by Bevan, *Nucleic Acid Res.* 12:8711–8721, 1984. Targets for the introduction of the genetic constructs of the present invention include tissues, such as leaf tissue, disseminated cells, protoplasts, seeds, embryos, meristematic regions; cotyledons, hypocotyls, and the like. Transformation techniques which may be usefully employed in the inventive methods include those taught by Ellis et al., *Plant Cell Reports*, 8:16–20, 1989; Wilson et al., *Plant Cell Reports* 7:704–707, 1989; Tautorus et al., *Theor. Appl. Genet.* 78:531–536, 198; Hiei et al., *Plant J.* 6:271–282, 1994; and Ishida et al., *Nature Biotechnol.* 14:745–750, 1996; U.S. Pat. No. 5,591,616; and European Patent Publication EP 672 752 A1. Once the cells are transformed, cells having the inventive DNA construct incorporated in their genome may be selected by means of a marker, such as the kanamycin resistance marker discussed above. Transgenic cells may then be cultured in an appropriate medium to regenerate whole plants, using techniques well known in the art. In the case of protoplasts, the cell wall is allowed to reform under appropriate osmotic conditions. In the case of seeds or embryos, an appropriate germination or callus initiation medium is employed. For explants, an appropriate regeneration medium is used. Regeneration of plants is well established for many species. The resulting transformed plants may be reproduced sexually or asexually, using methods well known in the art, to give successive generations of transgenic plants.

Polynucleotides of the present invention may also be used to specifically suppress gene expression by methods that operate post-transcriptionally to block the synthesis of products of targeted genes, such as RNA interference (RNAi), and quelling. For a review of techniques of gene suppression see *Science,* 288:1370–1372, 2000. Exemplary gene silencing methods are also provided in WO 99/49029 and WO 99/53050. Posttranscriptional gene silencing is brought about by a sequence-specific RNA degradation process which results in the rapid degradation of transcripts of sequence-related genes. Studies have provided evidence that double-stranded RNA may act as a mediator of sequence-specific gene silencing (see, e.g., review by Montgomery and Fire, *Trends in Genetics,* 14: 255–258, 1998). Gene constructs that produce transcripts with self-complementary regions are particularly efficient at gene silencing. A unique feature of this posttranscriptional gene silencing pathway is that silencing is not limited to the cells where it is initiated. The gene-silencing effects may be disseminated to other parts of an organism and even transmitted through the germ line to several generations.

The polynucleotides of the present invention may be employed to generate gene silencing constructs and or gene-specific self-complementary RNA sequences that can be delivered by conventional art-known methods to plant tissues, such as forage grass tissues. Within genetic constructs, sense and antisense sequences can be placed in regions flanking an intron sequence in proper splicing orientation with donor and acceptor splicing sites, such that intron sequences are removed during processing of the transcript and sense and antisense sequences, as well as splice junction sequences, bind together to form double-stranded RNA. Alternatively, spacer sequences of various lengths may be employed to separate self-complementary regions of sequence in the construct. During processing of the gene construct transcript, intron sequences are spliced-out, allowing sense and anti-sense sequences, as well as splice junction sequences, to bind forming double-stranded RNA. Select ribonucleases bind to and cleave the double-stranded RNA, thereby initiating the cascade of events leading to degradation of specific mRNA gene sequences, and silencing specific genes. Alternatively, rather than using a gene construct to express the self-complementary RNA sequences, the gene-specific double-stranded RNA segments are delivered to one or more targeted areas to be internalized into the cell cytoplasm to exert a gene silencing effect. Gene silencing RNA sequences comprising the polynucleotides of the present invention are useful for creating genetically modified plants with desired phenotypes as well as for characterizing genes (e.g., in high-throughput screening of sequences), and studying their functions in intact organisms.

EXAMPLE 1

Isolation of cDNA Sequences from *L. Perenne* and *F. Arundinacea* cDNA Libraries

*L. perenne* and *F. arundinacea* cDNA expression libraries were constructed and screened as follows. Tissue was collected from *L. perenne* and *F. arundinacea* during winter and spring, and snap-frozen in liquid nitrogen. The tissues collected include those obtained from leaf blades, leaf base, pseudostem, floral stems, inflorescences, roots and stem. Total RNA was isolated from each tissue type using TRIzol Reagent (BRL Life Technologies, Gaithersburg, Md.). mRNA from each tissue type was obtained using a Poly(A) Quik mRNA isolation kit (Stratagene, La Jolla, Calif.), according to the manufacturer's specifications. cDNA expression libraries were constructed from the purified mRNA by reverse transcriptase synthesis followed by insertion of the resulting cDNA in Lambda ZAP using a ZAP Express cDNA Synthesis Kit (Stratagene, La Jolla, Calif.), according to the manufacturer's protocol. T he resulting cDNA clones were packaged using a Gigapack II Packaging Extract (Stratagene, La Jolla, Calif.) employing 1 µl of sample DNA from the 5 µl ligation mix. Mass excision of the libraries was done using XL1-Blue MRF' cells and XLOLR cells (Stratagene, La Jolla, Calif.) with ExAssist helper phage (Stratagene, La Jolla, Calif.). The excized phagemids were diluted with NZY broth (Gibco BRL, Gaithersburg, Md.) and plated out onto LB-kanamycin agar plates containing 5-bromo-4-chloro-3-indolyl-beta-D-galactosidase (X-gal) and isopropylthio-beta-galactoside (IPTG). Of the colonies plated and picked for DNA preparations, the large majority contained an insert suitable for sequencing. Positive colonies were cultured in NZY broth with kanamycin and DNA was purified following standard protocols. Agarose gel at 1% was used to screen sequencing templates for chromosomal contamination. Dye terminator sequences were prepared using a Biomek 2000 robot (Beckman Coulter Inc., Fullerton, Calif.) for liquid handling and DNA amplification using a 9700 PCR machine (Perkin Elmer/Applied Biosystems, Foster City, Calif.) according to the manufacturer's protocol.

The DNA sequences for positive clones were obtained using a Perkin Elmer/Applied Biosystems Division Prism 377 sequencer. cDNA clones were sequenced from the 5' end. The polynucleotide sequences identified as SEQ ID NO: 4, 6, 11, 127, 128 and 132 were identified from *L. perenne* leaf cDNA expression libraries; the polynucleotide sequences identified as SEQ ID NO: 1, 14, 15, 26, 32, 36, 38, 41, 49, 125, 134, 141, 144, 147, and 150 were identified from *L. perenne* vegetative stem cDNA expression libraries; the polynucleotide sequences identified as SEQ ID NO: 17, 22, 25, 138, and 140 were identified from *L. perenne* leaf and pseudostem cDNA expression libraries; the polynucleotide sequences identified as SEQ ID NO: 43, 57, 61, 157, and 161 were identified from *L. perenne* pseudostem cDNA expression libraries; the polynucleotide sequences identified as SEQ ID NO: 10, 12, 28, 30, 34, 44, 60, 131, 133, 142, 143, 145, 151, and 160 were identified from *L. perenne* floral stem cDNA expression libraries; the polynucleotide sequences identified as SEQ ID NO: 8, 18, 46, 52, 53, 55, 59, 136, 152, 155, 156, 159, and 162 were identified from *L. perenne* stem cDNA expression libraries; the polynucleotide sequences identified as SEQ ID NO: 51 and 154 were identified from a *L. perenne* root cDNA expression library; the polynucleotide sequences identified as SEQ ID NO: 24, 27 and 139 were identified from *L. perenne* leaf blade cDNA expression libraries; the polynucleotide sequences identified as SEQ ID NO: 9, 37, 39, 40, 45, 130, 148, and 149 were identified from *F. arundinacea* basal leaf cDNA expression libraries; the polynucleotide sequences identified as SEQ ID NO: 19, 21, 29, 33, 35, 47, 48, and 153 were identified from *F. arundinacea combined day* 3 and day 6 basal leaves cDNA expression libraries; the polynucleotide sequence identified as SEQ ID NO: 54 was identified from a *F. arundinacea* combined day 3 and day 6 leaves cDNA expression library; the polynucleotide sequence identified as SEQ ID NO: 56 was identified from a *F. arundinacea* inflorescence cDNA expression library; the polynucleotide sequences identified as SEQ ID NO: 20 and 137 were identified from a subtracted *F. arundinacea* leaf blade cDNA expression library; the polynucleotide sequences identified as SEQ ID NO: 7, 23, 42, 50, 62, and 129 were identified from *F. arundinacea* pseudostem cDNA expression libraries; the polynucleotide sequences identified as SEQ ID NO: 2, 13, 16 and 135 were identified from *F. arundinacea* leaf cDNA expression libraries; and the polynucleotide sequences identified as SEQ ID NO: 3, 5, 31, and 126 were identified from a *F. arundinacea* inflorescence day 0 cDNA expression library.

BLASTN Polynucleotide Analysis

The isolated cDNA sequences were compared to sequences in the EMBL DNA database using the computer algorithm BLASTN. Comparisons of DNA sequences provided in SEQ ID NOS: 1–62 to sequences in the EMBL DNA database were made as of Oct. 19, 2001 using BLASTN algorithm Version 2.0.11 [Jan. 20, 2000], and the following Unix running command: blastall -p blastn d embldb -e 10-G0 -E0 -r 1 -v 30 b 30 -i queryseq -o. Comparisons of DNA sequences provided in SEQ ID NOS: 125–162 to sequences in the EMBL DNA database were made using BLASTN algorithm Version 2.2.1 [Apr. 13, 2001], and the following Unix running command: blastall -p blastn -d embldb -F F -e 10 -G0 -E0 -r 1 -v 2-b 2 -i queryseq -o.

The sequences of SEQ ID NO: 4–6, 9–11, 17–19, 21–26, 33, 44, 45, 48, 49, 51–55, 59, 60, 130–132, 136, 139, 146, 151, 154–156, 159, and 162 were determined to have less than 50% identity to sequences in the EMBL database using the computer algorithm BLASTN, as described above. The sequences of SEQ ID NO: 2, 3, 7, 8, 14, 16, 36–38, 46, 47, 50, 56–58, 61, 129, 135, 137, 138, 152, 153, 157, 158, 160 and 161 were determined to have less than 75% identity to sequences in the EMBL database using the computer algorithm BLASTN, as described above. The sequences of SEQ ID NOS: 1, 12, 13, 15, 20, 28, 31, 32, 35, 40, 62, 125–128, 133, 134, 142, 144 and 147 were determined to have less than 90% identity to sequences in the EMBL database using the computer algorithm BLASTN, as described above. Finally, the sequences of SEQ ID NOS: 29, 30, 39, 41–43, 141, 143, 148, and 149 were determined to have less than 98% identity to sequences in the EMBL database using the computer algorithm BLASTN, as described above.

BLASTP Polypeptide Analysis

The protein sequences corresponding to the isolated cDNA sequences were compared to sequences in the SwissProt/Trembl protein database using the computer algorithm BLASTP. Comparisons of protein sequences provided in SEQ ID NOS: 63–124 to sequences in the SwissProt/Trembl protein database were made as of Oct. 19, 2001 using BLASTP algorithm Version 2.0.11 [Jan. 20, 2000], and the following Unix running command: blastall -p blastp -dstdb-e 10 -G0 -E0 -v 30 -b 30 -i queryseq -o. Comparisons of protein sequences provided in SEQ ID NOS: 163–190 to sequences in the SwissProt/Trembl protein database were made using BLASTP algorithm Version 2.2.1 [Apr. 13, 2001], and the following Unix running command: blastall -p blastp dstdb -F F -e 10 -G0 -E0 v 2 -b 2 -i queryseq -o.

The sequences of SEQ ID NOS: 65–68, 72, 73, 78, 80, 81, 84, 85, 87, 88, 106, 107, 110, 111, 113–115, 117, 118 and 121 were determined to have less than 50% identity to sequences in the SwissProt/Trembl database using the computer algorithm BLASTP, as described above. The sequences of SEQ ID NOS: 71, 79, 82, 83, 86, 95, 98–100, 112, 116, 120, 122–124, 167, 168, 171–174, 185, 188, and 190 were determined to have less than 75% identity to sequences in the SwissProt/Trembl database using the computer algorithm BLASTP, as described above. The sequences of SEQ ID NOS: 63, 64, 69, 70, 74–77, 90, 91, 93, 94, 97, 101, 102, 104, 108, 109, 119, 175, 183, 187, and 189 were determined to have less than 90% identity to sequences in the SwissProt/Trembl database using the computer algorithm BLASTP, as described above. Finally, the sequences of SEQ ID NOS: 89, 92, 96, 103, 105, 163–165, 169, 170, 177, 179, 181, 184, and 186 were determined to have less than 98% identity to sequences in the SwissProt/Trembl database using the computer algorithm BLASTP, as described above.

BLASTX Polynucleotide Analysis

The isolated cDNA sequences were compared to sequences in the SwissProt/Trembl protein database using the computer algorithm BLASTX. Comparisons of DNA sequences provided in SEQ ID NOS: 1–62 to sequences in the SwissProt/Trembl protein database were made as of Oct. 19, 2001 using BLASTX algorithm Version 2.0.11 [Jan. 20, 2000], and the following Unix running command: blastall -p blastx -dstdb -e 10 -G0 -E0 -v 30 -b 30 -i queryseq -o. Comparisons of DNA sequences provided in SEQ ID NOS: 1–62 to sequences in the SwissProt/Trembl protein database were made using BLASTX algorithm Version 2.2.1 [Apr. 13, 2001], and the following Unix running command: blastall -p blastx -d stdb -F F -e 10 -G0 -E0 -v2 -b 2 -i queryseq -o.

The sequences of SEQ ID NOS: 11, 44, 45, 48, 49, 51, 52, 55, 130, 132, 155, 156, and 162 were determined to have less than 50% identity to sequences in the abase using the computer algorithm BLASTX, as described above. The NOS: 3–10, 16–26, 33, 36–38, 40–43, 50, 53, 54, 56, 58–62, 129, 131, 135–139, 146, 150, 151, 154, and 158–161 were determined to have less than 75% identity to sequences in the SwissProt/Trembl database using the computer algorithm BLASTX, as described above. The sequences of SEQ ID NOS: 1, 2, 12–15, 27, 28–32, 34, 35, 39, 46, 47, 57, 125–128, 133, 134, 141–145, 147–149, 152, 153, and 157 were determined to have less than 90% identity to sequences in the SwissProt/Trembl database using the computer algorithm BLASTX, as described above. Finally, the sequence of SEQ ID NO: 140 was determined to have less than 98% identity to sequences in the SwissProt/Trembl database using the computer algorithm BLASTX, as described above.

The location of open reading frames (ORFs), by nucleotide position, contained within the sequences of SEQ ID NO: 1–62 and 125–162, and the corresponding amino acid sequences are provided in Table 2 below. SEQ ID NO: 1–8, 10–15, 17, 19, 21, 23–25, 28–52, 54–59, 61–62 and 125–162 are believed to contain full-length ORFs.

TABLE 2

| POLYNUCLEOTIDE SEQ ID NO: | ORF | POLYPEPTIDE SEQ ID NO: |
|---|---|---|
| 1 | 56–2,020 | 63 |
| 2 | 64–2,010 | 64 |
| 3 | 64–1,926 | 65 |
| 4 | 74–1,945 | 66 |
| 5 | 40–1,911 | 67 |
| 6 | 79–1,938 | 68 |
| 7 | 246–1,514 | 69 |
| 8 | 264–1,532 | 70 |
| 9 | 84–3,272 | 71 |
| 10 | 73–3,297 | 72 |
| 11 | 129–2,942 | 73 |
| 12 | 46–2,472 | 74 |
| 13 | 113–2,539 | 75 |
| 14 | 61–2,505 | 76 |
| 15 | 103–2,253 | 77 |
| 16 | 3–1,439 | 78 |
| 17 | 26–1,777 | 79 |
| 18 | 2–1,174 | 80 |
| 19 | 59–1,852 | 81 |
| 20 | 2–1,201 | 82 |
| 21 | 1–1,779 | 83 |
| 22 | 198–1,097 | 84 |
| 23 | 27–1,772 | 85 |
| 24 | 36–1,802 | 86 |
| 25 | 78–2,084 | 87 |
| 26 | 2–1,423 | 88 |
| 27 | 3–1,622 | 89 |
| 28 | 85–1,764 | 90 |
| 29 | 72–1,751 | 91 |
| 30 | 127–1,800 | 92 |
| 31 | 137–1,810 | 93 |
| 32 | 62–1,567 | 94 |
| 33 | 80–1,597 | 95 |
| 34 | 32–1,117 | 96 |
| 35 | 86–1,171 | 97 |
| 36 | 55–852 | 98 |
| 37 | 75–872 | 99 |
| 38 | 149–1,240 | 100 |
| 39 | 90–1,118 | 101 |
| 40 | 28–1,110 | 102 |
| 41 | 66–1,148 | 103 |
| 42 | 64–1,146 | 104 |
| 43 | 85–1,170 | 105 |
| 44 | 88–1,683 | 106 |
| 45 | 93–1,721 | 107 |
| 46 | 111–2,246 | 108 |
| 47 | 144–2,285 | 109 |
| 48 | 22–993 | 110 |
| 49 | 4–1,038 | 111 |
| 50 | 87–1,067 | 112 |
| 51 | 59–1,135 | 113 |
| 52 | 18–1,052 | 114 |
| 53 | 1–882 | 115 |
| 54 | 80–1,015 | 116 |
| 55 | 322–1,014 | 117 |
| 56 | 172–762 | 118 |
| 57 | 118–1,299 | 119 |
| 58 | 5–595 | 120 |
| 59 | 14–1,003 | 121 |
| 60 | 1–987 | 122 |
| 61 | 65–1,174 | 123 |
| 62 | 103–1,245 | 124 |
| 125 | 55–2,019 | 163 |
| 126 | 63–1,925 | 164 |
| 127 | 73–1,944 | 165 |
| 128 | 71–1,930 | 166 |
| 131 | 72–3,299 | 167 |
| 132 | 134–2,950 | 168 |
| 133 | 45–2,471 | 169 |
| 134 | 65–2,512 | 170 |
| 135 | 74–1,819 | 171 |
| 136 | 170–1,855 | 172 |
| 137 | 28–1,770 | 173 |
| 138 | 26–1,733 | 174 |
| 139 | 35–1,801 | 175 |
| 140 | 71–2,083 | 176 |
| 141 | 63–1,607 | 177 |
| 143 | 126–1,799 | 178 |
| 144 | 61–1,566 | 179 |
| 145 | 67–1,152 | 180 |
| 147 | 148–1,239 | 181 |
| 149 | 27–1,109 | 182 |
| 151 | 87–1,718 | 183 |
| 153 | 143–2,284 | 184 |
| 156 | 46–1,017 | 185 |
| 157 | 117–1,313 | 186 |
| 158 | 81–1,193 | 187 |
| 159 | 12–1,001 | 188 |
| 160 | 26–1,018 | 189 |
| 162 | 50–1,027 | 190 |

SEQ ID NO: 125 and 163 are related to SEQ ID NO: 1 and 63, respectively; SEQ ID NO: 126 and 164 are related to SEQ ID NO: 3 and 65, respectively; SEQ ID NO: 127 and 165 are related to SEQ ID NO: 4 and 66, respectively; SEQ ID NO: 128 and 166 are related to SEQ ID NO: 6 and 68, respectively; SEQ ID NO: 129 is an extended sequence of SEQ ID NO: 7; SEQ ID NO: 130 is an extended sequence of SEQ ID NO: 9; SEQ ID NO: 131 and 167 are related to SEQ ID NO: 10 and 72, respectively; SEQ ID NO: 132 and 168 are related to SEQ ID NO: 11 and 73, respectively; SEQ ID NO: 133 and 169 are related to SEQ ID NO: 12 and 74, respectively; SEQ ID NO: 134 and 170 are related to SEQ ID NO: 14 and 76, respectively; SEQ ID NO: 135 and 171 are full-length sequences of SEQ ID NO: 16 and 78, respectively; SEQ ID NO: 136 and 172 are full-length sequences of SEQ ID NO: 18 and 80, respectively; SEQ ID NO: 137 and 173 are related to SEQ ID NO: 20 and 82, respectively; SEQ ID NO: 138 and 174 are full-length sequences of SEQ ID NO: 22 and 84, respectively; SEQ ID NO: 139 and 175 are related to SEQ ID NO: 24 and 86, respectively; SEQ ID NO: 140 and 176 are related to SEQ ID NO: 25 and 87, respectively; SEQ ID NO: 141 and 177 are full-length sequences of SEQ ID NO: 26 and 88, respectively; SEQ ID NO: 142 is related to SEQ ID NO: 28 and encodes the same amino acid sequence; SEQ ID NO: 143 and 178 are related to SEQ ID NO: 30 and 92, respectively; SEQ ID NO: 144 and 179 are related to SEQ ID NO: 32 and 94, respectively; SEQ ID NO: 145 and 180 are full-length sequences of SEQ ID NO: 34 and 96, respectively; SEQ ID NO: 146 is related to SEQ ID NO: 36 and encodes the same amino acid sequence; SEQ ID NO: 147 and 181 are related to SEQ ID NO: 38 and 100, respectively; SEQ ID NO: 148 is related t o SEQ ID NO: 39, and encodes the same amino acid sequence; SEQ ID NO: 149 and 182 are related to SEQ ID NO: 40 and 102, respectively; SEQ ID NO: 150 is related to SEQ ID NO: 41 and encodes the same amino acid sequence; SEQ ID NO: 151 and 183 is related to SEQ ID NO: 44 and 106, respectively; SEQ ID NO: 152 is related to SEQ ID NO: 46, and encodes the same amino acid sequence; SEQ ID NO: 153 and 184 are related to SEQ ID NO: 47 and 109, respectively; SEQ ID NO: 154 is related to SEQ ID NO: 51, and encodes the same amino acid sequence; SEQ ID NO: 155 is related to SEQ ID NO: 52, and encodes the same amino acid sequence; SEQ ID NO: 156 and 185 are full-length sequences of SEQ ID NO: 53 and 115, respectively; SEQ ID NO: 162 and 190 are variants of SEQ ID NO: 156 and 185, respectively, with a difference in the 5' region of SEQ ID NO: 156 and 162; SEQ NO: 157 and 186 are related to SEQ ID NO: 57 and 119, respectively; SEQ ID NO: 158 and 187 are related to SEQ ID NO: 58 and 120, respectively; SEQ ID NO: 159 and 188 are full-length sequences of SEQ ID NO: 59 and 121, respectively; SEQ ID NO: 160 and 189 are full-length sequences of SEQ ID NO: 60 and 122, respectively; and SEQ ID NO: 161 is related to SEQ ID NO: 61 and encodes the same amino acid sequence.

EXAMPLE 2

Use of Sucrose Phosphate Phosphatase to Dephosphorylate Sucrose-6-Phosphate

The *F. arundinacea* and *L. perenne* FaSPP and LpSPP genes (SEQ ID NO: 7 and 8, respectively) share amino acid sequence identity with sucrose-6-phosphate phosphatase genes from other plant species (Lunn et al., *Proc. Natl. Acad. Sci. USA* 97:12914–12919, 2000). These genes were amplified by PCR using the primers given in SEQ ID NO: 191 and 192 to add an initiating methionine, and then cloned into the pET41a expression plasmid (Novagen, Madison, Wis.). These primers amplified nucleotides 263–1531 and 280–1548 for FaSPP and LpSPP, respectively. The resulting plasmids were transformed into *E. coli* BL21 cells using standard protocols, and protein expression was induced using IPTG.

The soluble recombinant protein was assayed for its ability to specifically dephosphorylate sucrose-6-phosphate (Suc-6-P) but not fructose-6-phosphate (Fru-6-P) using the procedure described by Lunn et al. (ibid.). The release of phosphate from Suc-6P and Fru-6-P was measured using the Fiske-Subbarow method of determining inorganic phosphate (SIGMA assay kit; Sigma, St Louis, Mich.), with the change in absorbance at 660 nm being proportional to the amount of phosphate released per unit time. As shown in FIG. 1, both the *Festuca* and *Lolium* SPP enzymes dephosphorylated Suc-6-P but not Fru-6-P, whereas control pET41 extract had no activity on either substrate.

EXAMPLE 3

Peroxidase Activity of Grass Enzymes Demonstrated by Their Ability to Oxidize 2,2'Azino-Bis.3-Ethylbenzylthiazoline-6-Sulfonic Acid (Abts)

A number of *L. perenne* or *F. arundinacea* genes (SEQ ID NO: 48–54) share amino acid identity with peroxidase genes from other plant species (Hiraga et al., *Plant Cell Physiol.* 42:462–468, 2001). The putative amino acid secretion signal sequence was identified by signalP analysis of the *Lolium* and *Festuca* sequences and homology to known peroxidase proteins. Primers were designed to amplify DNA representing the mature protein (minus signal sequence; Table 3.). These genes were amplified by PCR to add an initiating methionine and then cloned into the pET25b expression plasmid (Novagen, Madison, Wis.). The resulting plasmid was transformed into *E. coli* AD494 (DE3) pLysS cells using standard protocols, and protein expression was induced using IPTG.

TABLE 3

| SEQ ID NO DNA | SEQ ID NO PROT | Gene | Primers SEQ ID NO: | DNA bp amplified | Protein codons |
|---|---|---|---|---|---|
| 50 | 112 | FaPER3 | 193 194 | 156–1077 | 24–326 |
| 52 | 114 | LpPER5 | 195 196 | 120–1052 | 35–344 |

The insoluble recombinant protein was solubilized and re-folded following protocols described for several recombinant *Arabidopsis* peroxidases (Teilum et al., *Protein Exp. and Purif.* 15:77–82, 1999). The insoluble inclusion bodies within *E. coli* were isolated from lysed cells by standard protocols and the recombinant protein solubilized in 8M urea. The solubilized peroxidase protein was refolded to gain active enzyme by diluting urea to 2M with 5 µM Heme, 0.25mM Glutathione reduced, and 0.45mM Glutathione oxidized, pH 8 (20 mM Tris-HCl). The refolded protein was used directly to assay peroxidase activity.

Figure 2:
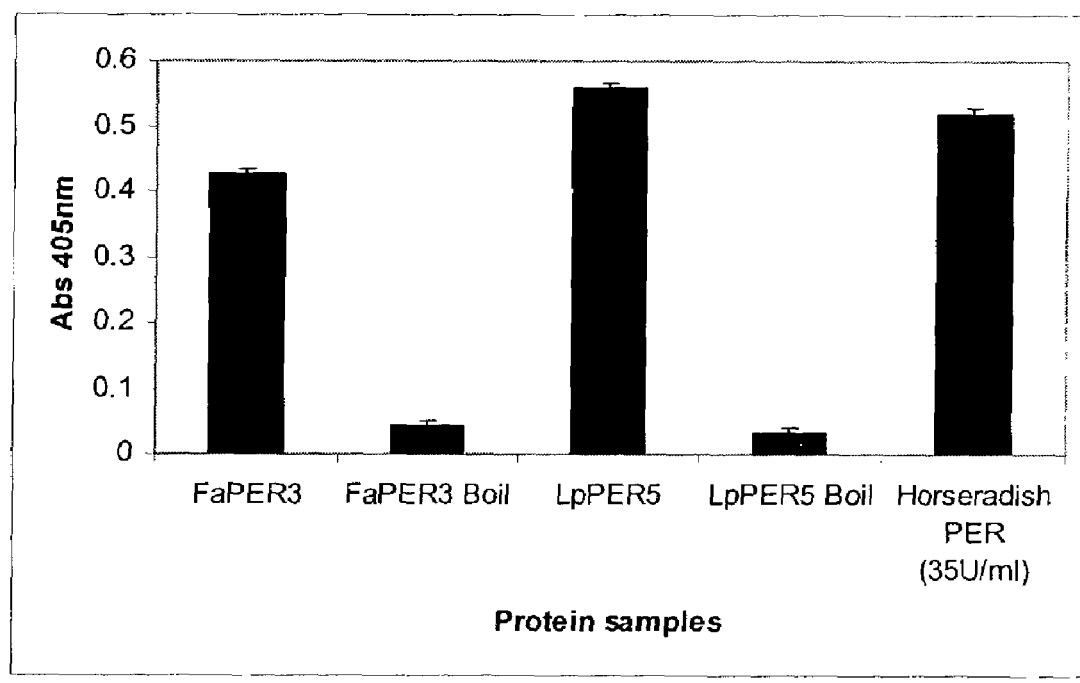
FIG. 2 shows the peroxidase activity of FaPER3 (SEQ ID NO: 50) and LpPER5 (SEQ ID NO: 52) as determined by oxidation of ABTS. Horseradish peroxidase of known activity (Sigma, St Louis, Mich.) was used as a positive control and boiled samples as a negative control.

Peroxidase activity was measured by incubating recombinant peroxidase with pre-mixed ABTS/$H_2O_2$ liquid substrate (Sigma, St Louis, Mich.) and measuring ABTS oxidation by the increase in absorbance at 405 nm. Horseradish peroxidase of known activity (Sigma, St Louis, Mich.) was used as a positive control and boiled samples as a negative control. The results provided in FIG. 2 show that FaPER3 and LpPER5 (SEQ ID NO: 50 and 52, respectively) had similar activity to that of horseradish peroxidase in these assays.

EXAMPLE 4

Use of Grass Fructosyltransferase Genes to Synthesize Fructans

Transformation of *N. benthamiana* Plants with Fructosyltransferase Genes

Sense constructs containing a polynucleotide including the coding region of fructosyltransferase genes isolated from *L. perenne* Lp1-SST and Lp6SFT1 (SEQ ID NO: 125 and 126, respectively) were inserted into a pART27 derived binary vector and used to transform *A. tumefaciens* LBA4404 using published methods (see, An et al., "Binary Vectors," in Gelvin and Schilperoort, eds., *Plant Molecular Biology Manual*, Kluwer Academic Publishers: Dordrecht, 1988). The presence and integrity of the binary vector in *A. tumefaciens* was verified by polymerase chain reaction (PCR). The primers px17 (SEQ ID NO: 207) and px18 (SEQ ID NO: 208) were used to confirm the presence of the Lp1-SST construct, whereas the primers px19 (SEQ ID NO: 209) and px 20 (SEQ ID NO: 210) were used to confirm the presence of the Lp6-SFT-1 construct.

Figure 3:
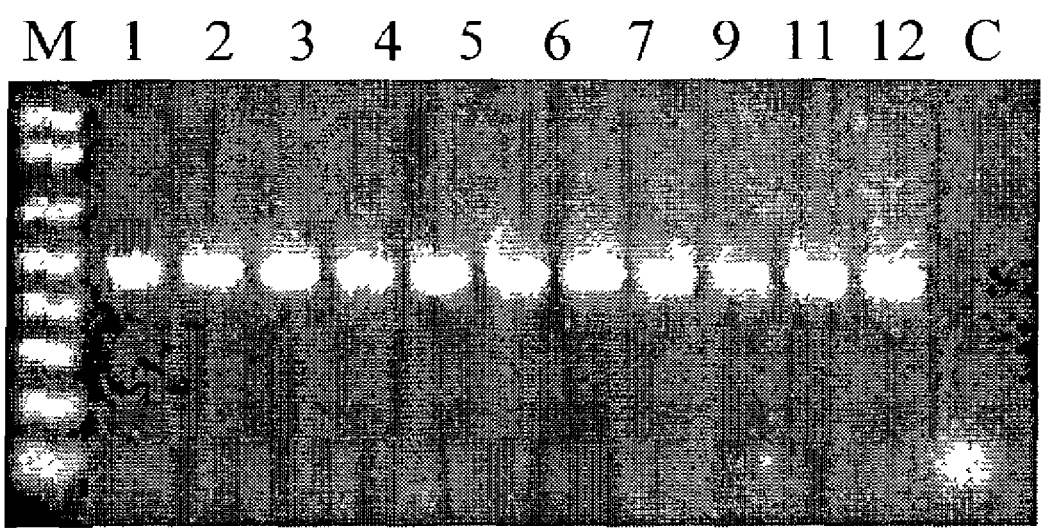
FIG. 3 shows PCR verification of transgenic *N. benthamiana* plants transformed with Lp6-SFT1 (SEQ ID NO: 3). Genomic DNA was isolated from kanamycin resistant T2 *N. benthamiana* plants and the Lp6-SFT1 fragment was amplified using specific PCR primers.
Figure 4:
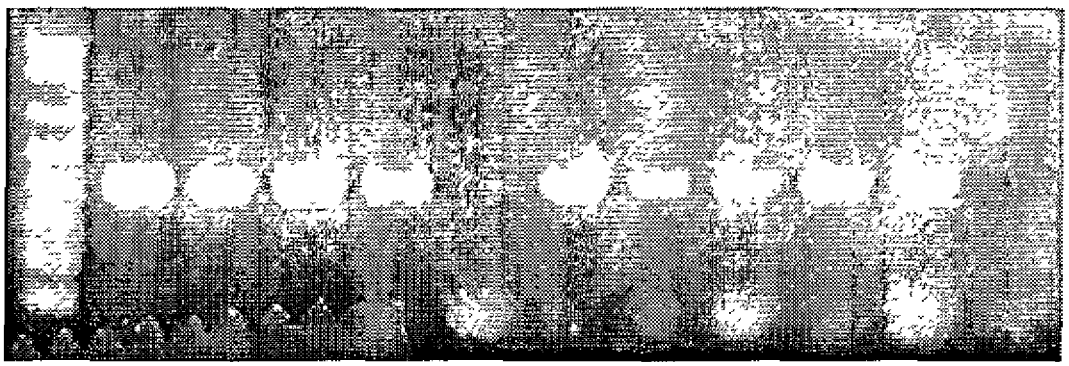
FIG. 4 shows PCR verification of transgenic *N. benthamiana* plants transformed with Lp1-SST (SEQ ID NO: 1). Genomic DNA was isolated from kanamycin resistant T2 *N. benthamiana* plants and the Lp1-SST fragment was amplified using specific PCR primers. Plant number 5 is a non-transgenic control.

The *A. tumefaciens* containing the sense gene constructs were used to transform *N. benthamiana* leaf discs (Burow et al., *Plant Mol. Biol. Report* 8:124–139, 1990). Several independent transformed plant lines were established for the sense construct for each fructosyltransferase gene. DNA was isolated from transformed plants containing the appropriate fructosyltransferase gene construct using the QIAGEN DNAeasy Plant Mini Kit (Qiagen, Valencia, Calif.). Presence of the fructosyltransferase gene was verified using PCR experiments as shown in FIGS. 3 and 4. For the Lp6-SFT1 gene, the forward and reverse primers given in SEQ ID NO: 197 and 198 were used, respectively. These primers amplify nucleotides 1572–1980 of the Lp6-SFT1 gene which corresponds to a 406 base pair fragment. For Lp1-SST, the forward and reverse primers given in SEQ ID NO: 199 and 200 were used, respectively. These primers amplify nucleotides 1332–1740 of Lp1-SST, corresponding to a 414 base pair fragment.

Effects of Fructosyltransferase Genes on Fructosyltransferase Concentration in Transformed Plants Fructans are not normally found in *N. benthamiana* plants; hence, if introduction of the sense fructosyltransferase constructs was successful, it should be possible to extract fructans from the transformed plants. The concentration of fructosyltransferase in the transformed plants was determined using the Fructan Assay Kit (Megazyme International Ireland Ltd, Wicklow, Ireland). Briefly, 300 mg of leaf material from the independent transformed plant lines containing the fructosyltransferase sense constructs were extracted individually at 80° C. with 1 ml 80% ethanol, followed by two 1 ml extractions with water. The ethanol and water extracts were combined and frozen overnight at −20° C. Extracts were centrifuged at 20,000 g to pellet chlorophyll. Clarified extracts were treated with 1% PVP-40 to precipitate phenolic compounds. These extracts were then reduced in volume by rotary evaporation.

Figure 5:
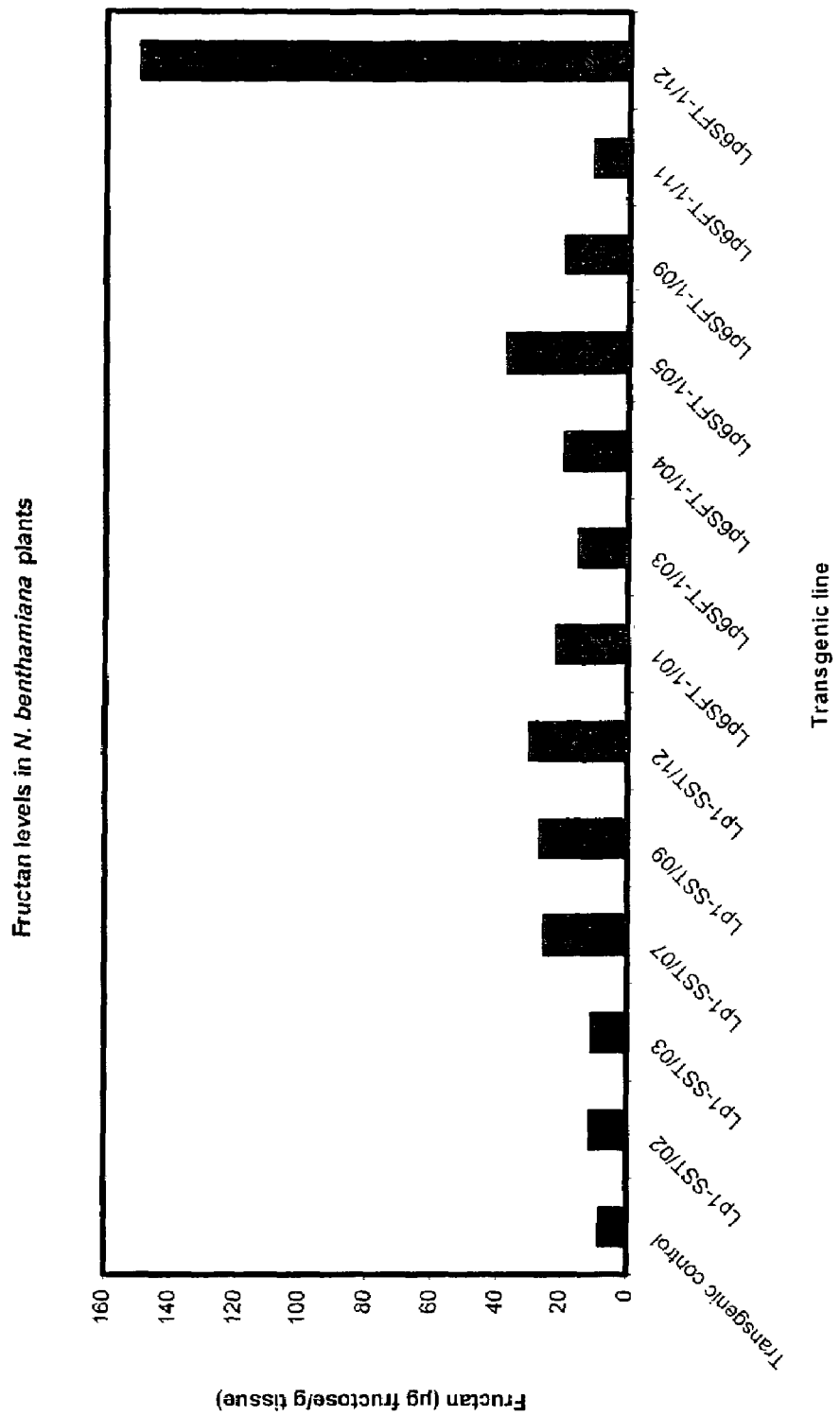
FIG. 5 shows the fructan level in transgenic *N. benthamiana* lines transformed with Lp6-SFT1 (SEQ ID NO: 3) and Lp1-SST (SEQ ID NO: 1).

Fructan levels were determined in these extracts using the Megazyme Fructan Assay kit. Briefly, sucrose, starch and reducing sugars are removed from the plant carbohydrate extracts by using sucrase, β-amylase, pullulanase and maltase, and then converting the resulting reducing sugars to sugar alcohols. The remaining fructans are hydrolyzed with fructanase and the reducing sugars produced (glucose and fructose) are measured by the 4-hydroxybenzoic acid hydrazide (PAHBAH) reducing sugar method. The final extracts are assayed for absorbance at 410 nm. As shown in FIG. 5, fructans could be detected in both the Lp1-SST and Lp6-SFT-1 transgenic lines. Fructan levels were highest in lines 07, 09 and 12 for Lp1-SST, and lines 05 and 12 for Lp6SFT-1.

EXAMPLE 5

Use of Sucrose Phosphate Synthase Enzymes to Synthesize Sucrose

A *F. arundinacea* gene (FaSPS-N; SEQ ID NO: 9) has been identified that shares amino acid sequence identity with sucrose phosphate synthase (SPS) from other plant species. SEQ ID NO: 7 and 8 are also SPS sequences, with SEQ ID NO: 7 being a *Lolium perenne* homologue of SEQ ID NO: 9. The FaSPS-N was cloned into the pcDNA3 mammalian expression plasmid and the resulting plasmid transfected into 293T mammalian cells (human embryonic kidney derived cells) using Lipofectamine 2000 reagent (Invitrogen, Carlsbad, Calif.).

Figure 6:
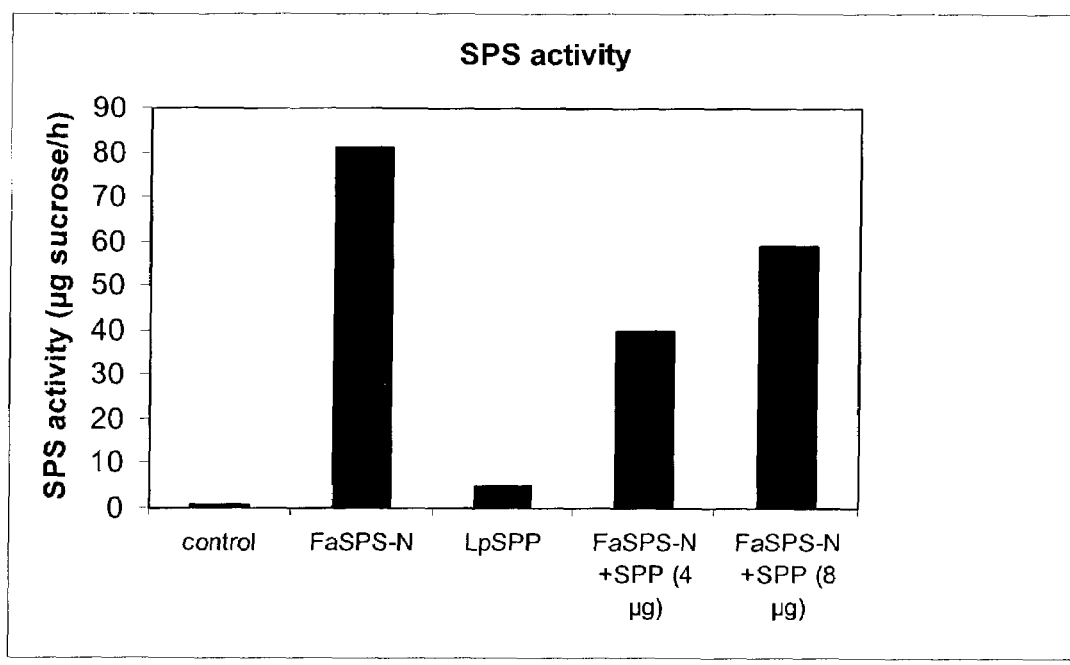
FIG. 6 shows the sucrose synthesizing activity of FaSPS-N (SEQ ID NO: 9) with and without SPP (SEQ ID NO: 8) in mammalian cell extracts. The non-transfected cells are controls.

Cell lysates from transfected cells were deionized on G25 spin columns and used in a sucrose synthesis assay. In this assay, mammalian cell extracts were tested for their ability to synthesize sucrose from fructose-6-phosphate and uridine 5′-diphosphoglucose. Following the synthesis reaction, hexoses were converted to sugar alcohols by boiling in the presence of 30% KOH. The sucrose synthesized was detected by the addition of 1.4% anthrone reagent in $H_2SO_4$ and incubating at 40° C. for 20 min. The change in absorbance at 620 nm is relative to sucrose in the reaction (Botha and Black, *Aust. J. Plant Physiol.* 27:81–85, 2000). In these experiments, introducing FaSPS-N alone into mammalian cells produced a sucrose synthesis activity that was not detected in non-transfected cells (FIG. 6).

A known cofactor for SPS is SPP. To test whether SPP is required for SPS activity, the *L. perenne* LpSPP gene (SEQ ID NO: 8) was cloned into the pcDNA3 mammalian expression plasmid. Both the FaSPS-N and LpSPP plasmids were co-transfected into 293T mammalian cells using Lipofectamine 2000 reagent (Invitrogen, Carlsbad, Calif.). Cell lysates from transfected cells were deionized on G25 spin columns and used in a sucrose synthesis assay as described above. As shown in FIG. 6, adding SPP did not significantly enhance or alter the sucrose synthesis activity of the cell extracts.

EXAMPLE 6

Use of Soluble Sucrose Synthase Enzymes to Cleave Sucrose

Figure 7:
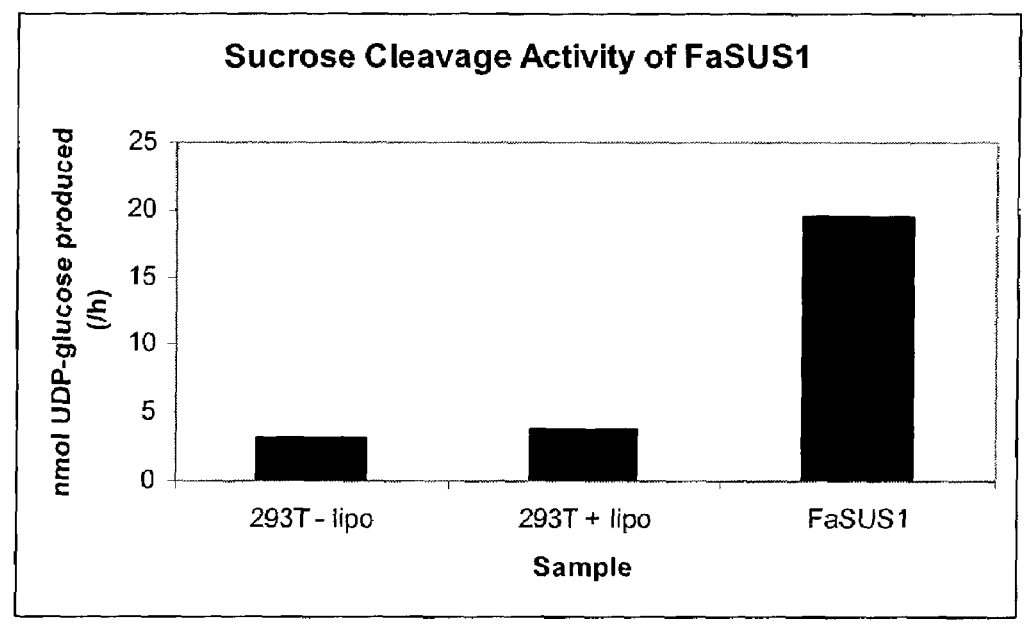
FIG. 7 shows the sucrose cleaving activity of FaSUS1 (SEQ ID NO: 13) in mammalian cell extracts.

A *F. arundinacea* gene (FaSUS-1; SEQ ID NO: 13) was identified that shared amino acid sequence identity with soluble sucrose synthase enzymes (SUS) from other plant species. Three other soluble sucrose synthases were also identified (SEQ ID NO: 12, 14 and 15) with SEQ ID NO. 12 being a direct homologue from *L. perenne*. The FaSUS-1 gene was cloned into the pcDNA3 mammalian expression plasmid, which was transiently transfected into 293T mammalian cells (human embryonic kidney derived cells) using Lipofectamine 2000 reagent (Invitrogen Carlsbad, Calif.). Transfected cells were grown for several days before harvesting (by scraping cells in a sucrose synthase buffer). Harvested cells were frozen on dry ice and freeze-thawed twice before pelleting cell debris by centrifugation. The resulting supernatant (cell lysate) was deionized on G25 spin columns and then used in a sucrose cleavage assay as described by Sebkova et al. (*Plant Physiol.* 108:75–83, 1995). In these assays, the cell lysates were tested for their ability to cleave sucrose in the presence of UDP to produce fructose and uridine 5′-diphosphoglucose. Following a 30 min incubation at 30° C., the enzyme activity was stopped by boiling the tubes for 1 min. Both NAD and UDP-glucose dehydrogenase were added and the change in OD at 340 nM (production of NADPH) was measured. As shown in FIG. 7, significantly higher levels of sucrose cleavage were observed in cells transfected with FaSUS1 construct than in non-transfected control cells.

EXAMPLE 7

Use of Acid Invertases to Cleave Sucrose

A number of acid (vacuolar and cell wall) invertase genes from *L. perenne* and *F. arundinacea* (SEQ ID NOS: 17, 19, 21, 23 and 135–141) were identified that share amino acid sequence identity with acid invertases from other plant species (Unger et al., *Plant Physiol.* 104:1351–1357, 1994; Goetz and Roitsch, *J. Plant Physiol.* 157:581–585, 2000). These sequences were analysed by SignalP and homology to identify signal regions and propeptide sequences, and primers were designed to amplify the DNA sequence encoding the mature protein (Table 4).

TABLE 4

| SEQ ID NO DNA | SEQ ID NO PROT | Gene | Primers SEQ ID NO | DNA bp amplified | Protein codons |
|---|---|---|---|---|---|
| 17 | 79 | LpCWINV1 | 201 202 | 137–1803 | 38–583 |
| 19 | 81 | FaCWINV4 | 203 204 | 134–1912 | 26–597 |
| 25 | 87 | LpSINV1 | 205 206 | 387–2124 | 104–668 |

Figure 8:
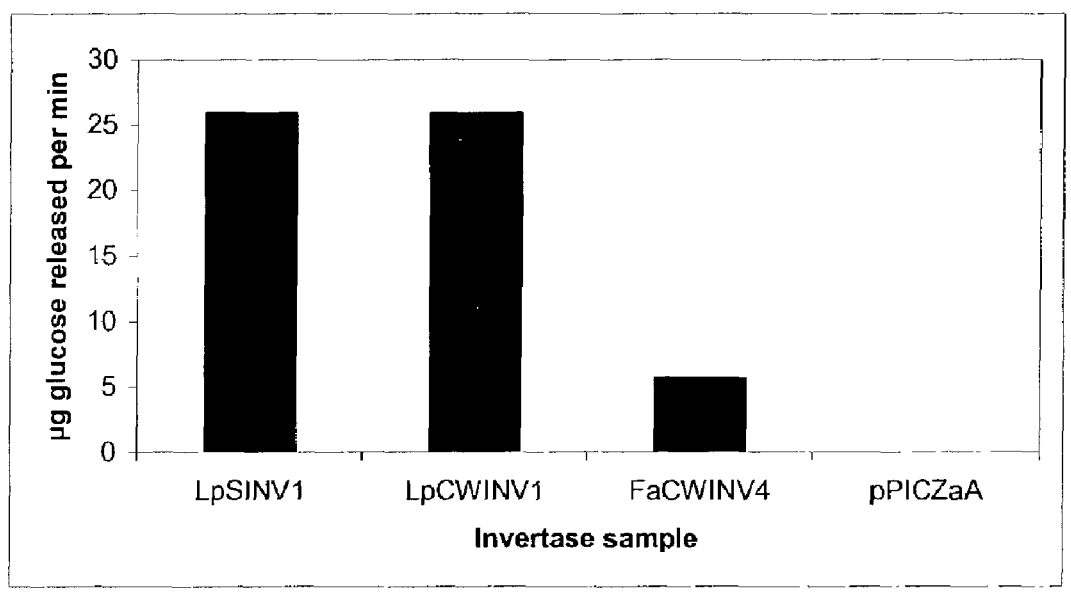
FIG. 8 shows the invertase activity for vacuolar invertase (LpSINV1, SEQ ID NO: 25) and two cell wall invertases (LpCWINV1 and FaCWINV4, SEQ ID NO: 17 and 19); absence of invertase activity from an empty vector (pPICZαA) control is also shown.

The PCR fragments were cloned into pPICZαA vectors for expression in methylotrophic yeast *Pichia pastoris* (EasySelect TM Pichia Expression Kit, Invitrogen, Carlsbad, Calif.). The sequences were cloned in frame with the α-mating factor for secretion of the recombinant invertase protein into liquid media, following similar methods described for the expression of barley 6-SFT and fescue 1-SST in *P. pastoris* (Hochstrasser et al., *FEBS Letters* 440:356–360, 1998; Lüscher et al., *Plant Physiol.*, 124:1217–1227, 2000). The media was concentrated 10 fold by Vivaspin 30 kDa spin column (VivaScience, Hannover, Germany) to concentrate recombinant protein and used directly to assay invertase activity. Recombinant protein was assayed with 100 mM sucrose in 500µl phosphate buffer pH 5.0, at 30° C. for 1 hour. Release of glucose by invertase activity was measured using a glucose HK assay kit (Sigma, St Louis, Mich.). FIG. 8 shows the glucose released by invertase activity in terms of glucose concentration in the assay mix. As shown in FIG. 8, invertase activity was observed for the vacuolar invertase (LpSINV1; SEQ NO: 25) and the two cell wall invertases (LpCWINV1 and FaCWINV4; SEQ NO: 17 and 19, respectively) but not for an empty vector (pPICZalphaA) control.

EXAMPLE 8

Use of Tannin Genes to Modify Tannin Biosynthesis

Certain *Arabidopsis* mutants of the *transparent testa* (tt) phenotype do not make the anthocyanin pigment cyanidin and therefore have no seed coat color. The genes responsible for many of these mutants have now been identified as shown in Table 5.

TABLE 5

| Enzyme | Abbreviation | Locus | Chromosome |
|---|---|---|---|
| Dihydroflavanol-4-reductase | DFR | tt3 | 5 |
| Chalcone synthase | CHS | tt4 | 5 |
| Chalcone isomerase | CHI | tt5 | 3 |
| Flavanone 3-β-hydroxylase | F3βH | tt6 | 3 |

Over-expression of the maize genes for CHS, CHI and DFR has been shown to complement the *Arabidopsis* tt4, tt5 and tt3 mutants, respectively, thereby restoring cyanidin synthesis and seed coat color (Dong et al., *Plant Physiol.* 127:46–57, 2001). Complementation of these *Arabidopsis* mutants may therefore be employed to demonstrate the function of the inventive polynucleotides encoding enzymes involved in the tannin biosynthetic pathway.

Sense constructs containing a polynucleotide including the coding region of tannin genes isolated from *L. perenne* or *F. arundinacea* LpCHS, LpCHI, LpFβH, LpDFR1, FaCHI and FaF3βH (SEQ ID NO: 157, 55, 161, 159, 56 and 62, respectively) under the control of the CaMV 35S promoter were inserted into a binary vector and used to transform *Agrobacterium tumefaciens* LBA4404 using published methods (see, An G, Ebert P R, Mitra A, Ha SB, "Binary Vectors," in Gelvin S B, Schilperoort R A, eds., *Plant Molecular Biology Manual*, Kluwer Academic Publishers: Dordrecht, 1988). The presence and integrity of the binary vector in *A. tumefaciens* was verified by polymerase chain reaction (PCR) using the primer pairs described in Table 6.

TABLE 6

| Gene | SEQ ID NO: | Transparent testa line | Forward Primer SEQ ID NO: | Reverse Primer SEQ ID NO: |
|---|---|---|---|---|
| LpCHS | 157 | tt4 | 211 | 212 |
| LpCHI | 55 | tt5 | 213 | 214 |
| LpF3βH | 161 | tt6 | 217 | 218 |
| LpDFR1 | 159 | tt3 | 215 | 216 |
| FaCHI | 56 | tt5 | 213 | 214 |
| FaF3βH | 62 | tt6 | 217 | 218 |

The *A. tumefaciens* containing the sense gene constructs are used to transform *Arabidopsis* by floral dipping (Clough and Bent, *Plant J.* 16:735–743, 1998). Several independent transformed plant lines were established for the sense construct for each of the tannin genes. Specifically, LpDFR1 constructs were transformed into *Arabidopsis* tt3 mutants, LpCHS constructs were transformed into *Arabidopsis* tt4 mutants, LpCHI and FaCHI constructs were transformed into *Arabidopsis* tt5 mutants, and LpF3βH and FaF3βH constructs were transformed into *Arabidopsis* tt6 mutants. Several independent transformed plant lines were established for the construct for each of the tannin genes. Transformed plants containing the appropriate tannin gene construct were verified using PCR.

The presence of cyanidin in the FaCHI transformed plants is demonstrated by a phenotypic change in plant seedling color and by analyzing cyanidin extracts made from transgenic plants grown under stressed conditions (Dong et al., *Plant Physiol.* 127:46–57, 2001). Briefly, cyanidins are extracted from plant tissue with an acid/alcohol solution (HCl/methanol) and water. Chlorophyll is removed by freezing the extracts followed by centrifugation at 4° C. at 20,000 g for 20 min. Any remaining chlorophyll is removed through a chloroform extraction. The absorbance at 530 nm is measured for each of the cyanidin extracts. Non-transgenic wild type and control *Arabidopsis* plants are used as controls.

SEQ ID NOS: 1–218 are set out in the attached Sequence Listing. The codes for nucleotide sequences used in the attached Sequence Listing, including the symbol "n," conform to WIPO Standard ST.25 (1998), Appendix 2, Table 1.

All references cited herein, including patent references and non-patent publications, are hereby incorporated by reference in their entireties.

While in the foregoing specification this invention has been described in relation to certain preferred embodiments, and many details have been set forth for purposes of illustration, it will be apparent to those skilled in the art that the invention is susceptible to additional embodiments and that certain of the details described herein may be varied considerably without departing from the basic principles of the invention.

SEQUENCE LISTING (219 sequences)

SEQ ID NO: 1 - DNA, 2106 bp, Lolium perenne
gacttagccttcctcggaaccatcgaccgggccgccgccgacgcgacgcgacgcgatggagtccagcgccgtcgtccccggcaccacggcgccgctgcttccttatgcgtacgcgccgctgccgtcgtcctccgacgacgcccgtgaaaacagaagtagcggcggcgtgaggtggcgcgcgtgcgccgtcgttctggcggactcggcgttggcggtggtggtcgtggtcgggctcctcgcgggcggcagggtggatcgggtcccggccggcgcagacgtggcgtcggccacggtgccggccgtgccgatggagttcccgaggagccggggcaaggacttgggcgtgtcggagaagtcctccggtgcctactccgccgacggcgggttcccgtggagcaacgccatgctgcagtggcagcgcaccgggttccatttccagccggagcagcactacatgaacgatcccaacggccccgtgtactacggcggatggtaccacctcttctaccagcacaaccccaagggcgacagctggggcaacatcgcctgggcccacgccgtgtccaaggacatggtcaactggcgccacctcccgctcgccatggttcccgaccagtggtacgacagcaacggcgtcctcaccggctccatcaccgtgctccccgacggccaggtcatcctgctctacaccggcaacaccgacaccctagcccaggtccagtgcctcgccacgcccgccgacccgtccgacccgctcctccgcgaatggatcaagcaccccgccaaccccatcctcttcccgccgcccgggatcgggctcaaggacttccgcgacccgctcaccgcctggttcgaccactccgaccacacctggcgcaccgtcatcgggtccaaggacgacgacggccacgccggcatcatcctcagctacaagaccaaggacttcgtcaactacgagctcatgcccgggaacatgcaccgcgggcccgacggcaccggcatgtacgagtgcatcgacctctaccccgtcggcggcaactcgtcggagatgctcggcggcgacgactcgcccgacgtgctcttcgtgctcaaggagagcagcgatgacgaacgtcacgactactatgcgctcggaaggttcgacgccgtcgccaacgtttggacgcccatcgaccgggacctggaccttgggatcgggctcagatacgactggggaaagtactacgcctccaagtccttctacgaccagaagaagaaccgccgcatcgtatgggcatacatcggcgagaccgactccgagcaggccgacatcaccaagggatgggccaatctcatgacgattccaagaacggtggagcttgacaggaagacccgcacaaacctcatccaatggccagtggaggaggtcgacaccctccgcaggaactccacggacctcggtcgcatcaccgtcaacgccggctccgtcattcgcctccccctccaccagggcgctcaactcgacatcgaggcctccttccaactcaactcttccgacgtggatgctatcaacgaggccgacgtcggctacaactgcagcaccagcggtgccgccgtacggggggcgctcggcccctttggcctcctcgtccttgccaatggccgcaccgaacagacggctgtgtacttctacgtgtccaagggcgtcgacggcggcctccagacccacttttgccacgacgagtcacggtcaacacgggcaaaggatgtcgtgaataggatgattggcagcatcgtgccggtgcttgacggtgagaccttttcggtgagggtgctagtggaccactccatcgtgcagagcttcgcgatgggcgggaggatcacggcgacgtcgcgggcgtacccgacggagaccatctacgcggccgcaggggtctacctcttcaacaacgccacgggcgccaccgtcaccgccgagaggctcgtcgtgcacgagatggcctcagctgacaaccatatcttcacgaacgacgacttgtagatgaaaccaagtttagctcgtgttgcattcttgttaacggccggtgattgcctatctacacattcatttggcgttcaaaaaaaaaa

SEQ ID NO: 2 - DNA, 2293 bp, Festuca arundinacea
gcatagtccactcagccttcctcggaaccatcgaccgggccgccgccgacgcgacgcgacgcgatggagtccagcgccgtcgtccccggcaccacggcgcggctgcttccttatgcgtacgcgccgctgccgtcgtccgccgacgacgcccgtgaaaaccagggtagcgacggcgtgaggtggcgcgcgtgcgccgccgtgttggccgcctcggcgttggcggtgctggtcgtggtcgggctcctcgcggggggcagggtggatcggccgggtccggccgcggtgccggcggtgccgacggagatcccgaggagccggggcaaggacttcggcgtgtcggagaagtcgtccggggcctactccgccgacggcgggttcccgtggagcaacgccatgctgcagtggcagcgcaccgggttccacttccagccggagcagcactacatgaacgatcccaacggccccgtctactacggcggatggtaccacctcttctaccagtacaaccccaagggcgacagctggggcaacatcgcgtgggcccacgccgtgtccaaggacatggtcaactggcgccacctcccgctcgccatggtgcccgaccagtggtatgacagcaacggcgtcctcaccggctccatcaccgtgctccccgacggccgggtcatcctgctctacaccggcaataccgacaccctggcccaggtccagtgcctcgccgagcccgccgacccgtccgacccactcctccgcgaatggatcaagcacccggccaaccccatcctcttcccgccgcccgggatcggcctcaaggacttccgcgaccccctcaccgactggttcgatcactccgacgacacctggcgcactgtcattgggtccaaggacgacgacggccacgccggcatcatcctcagctacaagacaaaggacttcgtcaactacgagctcatgccggggaacatgcaccgaggccccgacggcaccggcatgtacgagtgcatcgacctctacccagtgggcggcaactcgtcggagatgctcggcggcgacgactcgcccgacgtgctctttgtgctcaaggagagcagcgatgacgagcgtcacgactactacgcgctcgggaggttcgacgccgccgccaacatttggacacccatcgaccaggagctggacctcgggatcgggctcaggtacgactggggaaagtactacgcctcaaagtccttctacgaccagcggaagaaccgccgcgtcgtatgggcctacatcggcgagaccgactccgagcaggccgacatcaccaagggatgggccaatctcatgacgatcccaagaacggtggagcttgacaagaagacccggacaaacctcatccaatggccagtggaggaggtcgacaccctccgcaggaactccacggacctcggtcgcatcaccgtcaacgccggctccgtcattcgccttcccctccaccaaggcgctcaactcgacatcgaggcctccttccagctcaactcttccgacgtggatgctctcaacgaggctgacgtcggctacaactgcagcaccagcggtgccgccgtgcgtggggcgctcggcccctttggcctcctcgtccttgccaacggccgcaccgaacagacggctgtgtacttctacgtgtccaagggcgttgatggcgccctccagacccacttctgccacgacgagtcacggtcgacgcgggcaaaggatgttgtgaataggatgattggcagcatcgtgccggtgcttgacggtgagaccttctcggtgagggttctattggaccactccatcgtgcagagcttcgcgatgggtgggaggatcacagcgacgtcgcgggcgtacccgactgaggctatctacgcagcggcgggggtctacgtcttcaacaacgccacgggtgccaccgtcactgccgagaggctcgtcgtgtacgagatggcctcggctgacaaccatatcttcaggaacgacgacttgtagatgaaaccaagtcgagctcttgttgcattcatggtcatcggtgatcgcccctgtctacacatccatttggcattcggtcggcgggttcctcgatcttgtcatggatggggatcaagatggagtacaatagttttcggtttgtttttttgtatcggtgagatgaatggaaattagatgactgtcctgcccccaagtgcaactatctgcaggagcacttctgcagtgactatgatgacggtgtcatgtatcaactgtaccagatctttttaattgaaaaaaaaaa

SEQ ID NO: 3 - DNA, 2072 bp, Festuca arundinacea
gcccatccaccggagtatactaggaaattcctgcaactcgacctcgcgttgggaattccggcaatggagtcccgggcctttcccaacgcggcgtacgcgccacttctgccacccaccgctgacgacgccaccctgggcaagcaggaccgccccggcgtggggtggcgcgggttcttaaccgtgctggccgcgtctggcgtggtggtgctcctcgtcgctgccactatgctcgcgggatccaggatgggtcaggcaggcgacaccgacgaggacggggccggagggttcccgtggagcaacgagatgctgcagtggcagcgcgccgggttccattaccagcccgaggggcacttcatgagcgatccagacggtccggtatactaccgtggatattaccacctcttctttcagtacaaccgaaggggcgtcgcgtgggatgactacatagagtggggccacgtggtgtcccaggacctggtacactggcgccctctcccactggccctgcggcctgaccattggtacgacaagaagggcgtcttgtcgggtaccatcacggtgctccacaatggcacgctcgtcctgctctacacgggggtcacagaagaccctatggccgagtctcagtgcatcgccgtcccgaccgaccccaacgaccccctccttcgccattggaccaagcaccccgccaaccctgttctcgctcacccacagggggtccagggcatggacttccgagaccccaccagtgcatggtttgacaagtccgacgccacgtggcgcattctcatcggttccaaggatgacgacaatggaagccacgctggcatcgccttcatcttcaagaccaaggacttccttagcttcgagcgcgtcccaggtatcgtgcatcgtgtcgagggtaccggtatgtgggagtgcatcgacttttaccccgtcggaggtggccacaactcttcgtcggaggagctgtacgtgataaaggcgagcatggacgacgaacgacacgactactactcattggggagatatgacgcggcagccaacacatggacgccattggacgccgagctagacttggggattgggctgagatacgactggggcaagctctacgctgccacgtcgttctacgatccgctgaagcagcggcgaattatgttggggtatgtaggcgagaccgactctgcacgagccgacgttgccaagggatgggcctcacttcagtcgattccgaggacagtgacactagacgagaagaccaggacgaacctcctcctatggccggtggaggaggtggaggccctccgctacaactccaccgacctcagtggcatcactgttgacaacggctcagtcttccacctccccctccaccaagccactcacctggacatcgaggcttccttccgcctcgacgcttctgacgttgccgccatcaacgaggccgatgtcggctataactgcagcagcagcggtggcgcggccgcacgtggcgctatcggccccttcggcctcctcgtccatgccgccggagacctccgtggcgagcagacggcggtgtacttctacgtgtccagggccctcgacggtaccctccggactagcttctgcaacgacgagacgcggtcgtcacgggccagggacgtgacgaagcgggtggtgggcagcacggtgccggtgctccacggtgaggcgttgtcgatgagggtgctcgtggaccactccatcgtgcagagcttcgccatgggtgggagagtcacggcgacctcgcgggtgtacccaacggaggccatctacgccagggcaggggtgtacctgttcaacaacgctaccggcgccagcgtgactgcggagaggctcatcgtgcacgagatggcctcggcggtatacgacgagaccctgatcatggttgaggactcgtagctgctcacatgagctatatatcagaccggtaacgttgggtcacttgcatttccaagcgttgaataatttacttagcttagcaagcaacaggtccgaggttccaagtaaggggtgggatttttttcccggtttccaaaaaaaaaaaa

SEQ ID NO: 4 - DNA, 2207 bp, Lolium perenne
gcacccatccaccggaatatatatactagtcaggaaattcctgcaactcgacctcgagttgggaattccggcaatggagtcccgggcctttcccagcgcggcgtacgcgccacttctgccatccgccgcagacgacgtcgccctggccaagcaggaccgccccggcgtggggtggcgcgggttcttaaccgtgctggccgcctgcggcgtggtggtgctcctcgtcggtgccactttgctcgcgggatccaggatgggtcaggcaggcgacggcgaaggcaacaccgacgaggatggggccggagggttcccgtggagcaacgagatgctgcagtggcagcgcgccgggttccattaccagccggaggggcacttcatgagcgatccaaacggtccagtatactaccgcggatattaccacctcttctttcagtacaaccgaaggggcgtcgcgtgggatgactacatagagtggggccacgtggtgtcccaggacctggtacactggcgccctctcccactggccatgcggcctgaccattggtacgacaagaagggcgtcttgtcgggtaccatcacggtgctccacaatggcacgctcgtcctgctctacacgggggtcacagaagaccctatggccgagtcccagtgcatcgccgtcccgaccgaccccaacgaccccctccttcgccattggaccaagcaccccgccaaccccgtccttgctcacccacagggggtccagggcatggacttccgagaccccaccagcgcgtggtgggacaagtccgatgccacgtggcgcattctcatcggttccaaggacgacgacaacggcagccacgctggcatcgccttcatcttcaagactaaggacttccttagcttcgagcgtgtcccaggtatcgtgcatcgtgtcgagggcaccggcatgtgggagtgcatcgacttttaccccgtcggaggtggccacaactcttcgtcggaggagttgtacgtgataaaggcgagcatggacgacgaacgccacgactactactcattggggaggtacgacgcggcagcgaacacatggacgccattggacgccgagctagacttggggattgggctgagatacgactggggcaagctctacgcttccacgtcgttctacgatccggtgaagcagcggcgcattatgttggggtatgtaggcgaggtcgactctgcgcgagccgatgttgccaagggatgggcctcgcttcagtcgattccgaggacagtggcgctagacgagaagacccgaacgaacctcctcctatggccggtggaggaggtggaggccctccgctacaactccaccgacctcagcggcatcaccattgacaacggctccgtcttccacctcccactccaccagaccactcagctggacatcgaggcttccttccgcctcgacgcttctgatgttgccgccatcaacgaggccgacgtcggctacaactgcagcagcagcggcggcgcggcggcacgtggcgctctcggccccttcggcctcctcgtccatgccgccggagacctccgtggcgagcagacggcggtctacttctacgtgtccagggccctcgacggtaccctccggaccagcttctgcaacgacgagacgcggtcgtcgcgggccagggacgtgacgaagcgggtggtgggcagcacggtgccggtgctcgacggcgaggcgttgtcgatgagagtgctcgtggaccactccatcgtgcagagcttcgcgatgggcgggaggaccacggcgacctcgcgcgtgtacccgacggaggccatctacgccagggctggggtgtacctgttcaacaacgccaccggcgccggcgtgacggcggagaggctcatcgtgcacgagatggcctcggcggtatacgacgagaccctcatggttgaggactcatagctgctcacccgtaacgttgggtcacttgcatttccaagcgttgaattaataatttacttgttgtagcagcaagcaacggtccaaggttccaagtaaggtgggatattataccaaactccgcaagtcccgcaaggttgtgtaggtgtaagttaatgttggcgcacctgcgcgtgtgcatgtaagttgttgtatttgttgttcttttaaaaaagaaagataccaatctaccatcctatgtaagcataaaaaaaaaaaaaaaaaa

SEQ ID NO: 5 - DNA, 2163 bp, Festuca arundinacea
gaattcctgcaactcgacctcgagttgggaattccggcaatggagtcccgggcctttcccagcgcggcgtacgcgccacttctgccacccaccgctgacgacgccaccctgggcaagcaggaccgccccggcgtggggtggcgcgggttcttaaccgtgctggccgcgtctggcgtggtggtgctcctcgtcgctgcctctttgctcgcggggtccaggatgggtcaggcaggcgacggcgaaggcaacaccgacgaggacggggccggagggttcccgtggagcaacgagatgctgcagtggcagcgcgccgggttccattaccagcccgaggggcacttcatgagcgatccagacggtccggtatactaccgtggatattaccacctcttctttcagtacaaccgaaggggcgtcgcgtgggatgactacatagagtggggccacgtggtgtcccaggacctggtacactggcgccctctcccagtggccatgcggcctgaccattggtacgacaagaagggcgtcttgtcgggtaccatcacggtgctccacaatggcacgctcgtcctgctctacacgggggtcacagaagaccctatggccgagtcccagtgcatcgccgtcccgaccgaccccaacaaccccctccttcgccattggaccaagcaccctgccaaccctgttctcgcacacccacagggggtccagggcatggacttccgagaccccaccagcgcatggtttgacaagtccgacgcgacgtggcgcattctcatcggttccaaggacgacgacaatggaagccacgctggcatcgccttcatcttcaagaccaaggacttccttagcttcgagcgcgtcccgggtatcgtgcatcgtgtcgagggtaccggtatgtgggagtgcatcgacttttaccccgtcggaggtggccacaactcttcgtcggaggagctgtacgtgataaaggcgagcatggacgacgaacgacacgactactactcattggggagatatgacgcggcagccaacacatggacgccattggacgccgagctagacttggggattgggctgagatacgactggggcaagctctacgctgccacgtcgttctacgatccgctgaagcagcggcgaattatgttggggtatgtaggcgagaccgactctgcgcgagccgacgttgccaagggatgggcctcacttcagtcgattccgaggacagtgacactagacgagaagaccaggacgaacctcctcctatggccggtggaggaggtcgaggccctccgctacaactccaccgacctcagtggcatcactattgacaacggctcagtcttccacctccccctccaccaagccactcagctcgacatcgaggcttccttccgcctcgacgcttctgacgttgccgccatcaacgaggccgacgtcggctacaactgcagcagcagcggtggcgcggccgcacgtggcgctatcggccccttcggcctcctcgtccatgccgccggagacctccgtggcgagcagacggcggtgtacttctacgtgtccagggccctcgacggtaccctccggaccagcttctgcaacgacgagacgcggtcgtcacgggccagggacgtgacgaagcgggtggtgggcagcacggtgccggtgctcgacggtgaggcgttgtcgatgagggtgctcgtggaccactccatcgtgcagagcttcgccatgggtgggagagtcacggcgacctcgcgggtgtacccgacggaggccatctacgccagggcaggggtgtacctgttcaacaatgccaccggcgccagcgtgactgccgagaggctcatcgtgcacgagatggcctcggcggtgtacgacgagaccctcatggttcaggactcatagtttctcacatgagctatcagactggtaacgttgggtcacttgcatttccaagggttaaataatttacttagcgtagcaactggtccgaggttccaagtaaggtgggatattcttccaaactccgcgagtcccgtcaggttgtgttggtgtgagtgtgatgttggcgcacctgcgcgtgtgcatgtaagttgttgtatttgttgtttctatacctaataataaaggaaaaaggatttctccctaaaaaaaaaa

SEQ ID NO: 6 - DNA, 2200 bp, Lolium perenne
agccgaggcacccatccaccggagtatactagctaggaaattcctgtgcaactcgacctcgagtttggaattccggcaatggagtcccgggactttcccagcgcggcgtacgcgccacttctgccatctgccgcagacgacgtcgccctggccaagcaggaccgccccggcgtggggtggcgcggcttcttaaccgtgctggccgcctgcggcgtggtggtgctcctcgtcgctgcctctttgctcgcggggtccaggatgggtcaggcaggcgacaccgacgaggacggggccggagggttcccgtggagcaacgagatgctgcagtggcagcgcgccgggttccattaccagccggaggggcacttcatgagcgatccagacggtccggtatactaccgtggatattaccacctcttctttcagtacaaccgaagaggggtcgcgtgggatgactacatagagtggggccacgtggtgtcccaggacctggtacactggcgccctctcccactggccatgcggcctgaccattggtacgacaagaagggcgtcttgtcgggtaccatcacggtgctccacaatggcacgctcgtccttctctacacgggggtcacagaagaccctatggccgagtcccagtgcatcgccgtcccgaccgaccccaacgacccccttcttcgccattggaccaagcaccccgccaaccccgttctcgctcacccacagggggtccagggcatggacttccgagaccccaccagcgcgtggtgggacaagtccgactccacgtggcgcattctcatcggttccaaggacgacgacaacggcagccacgctggcatcgccttcatcttcaagaccaaggacttccttatcttcgagcgtgtcccaggtatcgtgcatcgtgtcgagggtaccggcatgtgggagtgcatcgacttttaccccgttggaggtggccacaactcttcgtcggaggagttgtacgtgataaaggcgagcatggacgacgaacgacacgactactactcattggggaggtatgacgcggcagcgaacacatggacgccattggacgccgagctagacttggggattgggctgaggtacgactggggcaagctctacgcttccacgtcgttctacgatccactgaagcagcggcgaattatgttggggtatgtaggcgatgtcgactctgcgcgagccgacgttgccaagggatgggcctcacttcagtcgattccgaggacagtggcactagacgagaagacccggacgaacctcctcctatggccggtggaggaggtggaggccctccgctacaactccaccgacctcagcggcatcactgttgagaacggctccatcttccacctccctctccaccaagccactcagctggacatcgaggcttccttccgcctcgatgcttctgatgttgctgccatcaacgaggccgacgtcggctacaactgcagcagcagcggtggcgcggccgctcgtggcgctctcgggcccttcggcctcctcgtccatgccgccggagacctccgtggcgagcagacggcggtgtacttctacgtgtccagggccctcgacggtagcctccggaccagcttctgcaacgacgagacgcggtcgtcacgggcccgggacgtggcgaagcgggtggtgggcagcacggtgccggtgctcgacggcgaggtgttagcgatgagggtgctcgtggaccactcgatcgtgcagagcttcgcgatgggtggaagggtcacggcgacgtcgcgggtgtacccaacggaggctatctacgccagggcaggggtgtacctgttcaacaacgccaccggcgccagcgtgacggcggagaggctcatcgtgcacgagatggcctcggcggtatacgacgagaccgtcatggttaaggactcatagctgctcacacatgagctatcagaccggtaacgttgggtcactagcattttcaagcgttaggataatttacttggcgtagcaagccccgggtccgaggttccaaaagtaaggtgggatattcttccaaactccgcgagtcccgcaaggttgtctaggtgtaagtgtaatgtcgtttgcgcacctgcgcgtgagcttgtaatttgctggatttgttgtttatttacagaaaaaaaaggatactatactatgtaagtatctacat

SEQ ID NO: 7 - DNA, 1756 bp, Festuca arundinacea
cccatctctcccgaaacaaccgctcgccacccgtctccctcccctgccctcgcctccccattccccttcctcttcttcccttggcgacggcctcgtcgatcggacccaatctccaccaaacgcgcctccggatctcgcgcgccgcctcgaaggggatcctcccgtggccgccgtcctcctccgccgctcggctggactgtcgtggagcggggatcgacccgggctctctgtcgctggttgctaaaatggataagctcaatggttctgcgcgtcttatgattgtttcagacctcgatcatacaatggttgatcatcatgacgaagagaacttgtcgttgcttaggtttggggccctttgggagtctgcttactgtcaggattctctacttgtcttctcgaccggaagatcacccactctctataaggaattgaggaaagagaagcctatgctaactccagacatcactattatgtcggtgggcagtgagataacttatggtgaggccatggttcctgatgatggctgggaggaatatctgaacaataagtgggacagaaatattgttcttgaggagaccgctaagtattctgagctgaagcttcagccagagacagaacagcgtccacataaggtcagcttcttggttgacaagaagagtgctcaggaagtgataaagtctctctctgagaagtttgagaaacgtggggtagatgcaaaaataatctatagtggtggccaagaccttgacatattagctcaaggggctggaaagggtcaggcgcttgcatatttactcaagaagttcgcctcatgcgggaaaacacccaacaatactcttgtttgtggtgactctggcaatgatgcagaattattcagcatccctggtgtgcacggtgtcatggttagcaatgcccaagaggaactactccagtggcatgcagaaaatgcgaaggataaccctaaggtaattcatgcaactgagaggtgtgctgctggtattattcaagctattgggcacttcaagctaggacctaatatttctccaagagacattgagtttccttacgtcaaggaggactctttcaagcctacagcggctgttgtgaagttctatgttctctgcgagaagtggcgtagggctgacgttccaaaggctgattcagttatagagtacttcaaaaacatcacggatgcaagtggagttattattcatccctctggcctcgaactttcgatccattcttccatcgatgcgttggcttcatgttatggtgacaaacaagggaaaaagtaccgatcatgggtggacagactagttatctcacagactgcttctgacagttggcttgtgagatttgacttgtgggaggcagaaggtgatgcatgggtgtgctgtttgacaactcttgcgctgaatgtaaagcctgaaacccctgggggtttcgtggtaacacacatccacaagacatggctcaaagaatattccggggatgagcaggcgtccaaactctagactggatctctaccgtcagcgcacgggaaggaaattttcttgagaatcaaataagaagcgcacagaaaacacgagaatttcttttccttgttcataatgttaataagtgctcccagacactacatatatcatactggatgaagtatacggaggtcttgatgcttggcctaatgcttacttgatgtgtaagataaaaatattatatctcgttactggcatgagaagctgaagtaaaaaaaaaa

SEQ ID NO: 8 - DNA, 1778 bp, Lolium perenne
ggaaccacaaaggcgctcgcccatctctcctccttcccgaaacaaccgctcgccacccgtctcccctcccctgccctcgcctccccattcccctccctcttcttcccttggccacggcctcctcgatcggacccaatctccaccacacgcgcctccggatctcgcgcgccgcctccaaggggatcctcccgtcctcccccgccgctcggctggaccgtcgtcgagcggggatcgacccgggctctccgtcgctggttgctaaaatggataagctcaatggttctgcgcgtctcatgattgtttcagacctcgaccatacaatggttgatcaccatgacgaagagaacttgtctctgcttaggtttggggccctttgggagtctacttactgccaggattctcttcttgtcttctcgaccggaagatcgcccactctctataaggaattgaggaaagagaagcctatgctgactccagacatcactattatgtcggtgggcagtgagattacttatggcgaggccatggttcctgatgatggctgggaggaatatctcaacaataagtgggacaagagtattgttcttgaggagaccgctaagttttctgagctgaagcttcaggcagagacagaacagcgtccacataaggtcagcttcttggttgacaagaagactgctcaggaagtgatcaagtctctctctgaaaagtttgagaaacgtggggtagatgcgaaaataatctatagtggtggccaagaccttgacatattagctcaaggggctggaaagggtcaggcgcttgcatatttactcaagaagttcgcctcatgcgggaaaacacccaacaatactcttgtttgcggtgactctggcaatgatgcagaattattcagcatccctggtgtgcacggtgtcatggttagcaatgcccaagaggaactactccagtggcgtgcagaaaatgcgaaggataaccctaaggtaattcatgcaactgagaggtgtgctgctggtattattcaagctatcgggcacttcaagctaggacctaatgtttctccaagagacgttgagtttccttacgtcaaggaggactctttcaagcctacagcggctgttgtgaagttctatgttctctgcgagaagtggcgtagggctgacgttccaaagactgattcagttatagagtacttcaaaaacatcacggatgcaagtggagttattattcatccctctggccttgaactttcgatccattcttccatcgatgcgttggcttcatgttatggtgacaaacaagggaaaaagtaccgatcatgggtagacagactagttatctcacagactgcttctgacagttggcttgtgagatttgacttgtgggaggcagaaggtgataagtgggtgtgctgtttgacaactcttgcgctgaatgtaaagcctgaaacccctgggggtttcgtggtaacacacatccacaagacatggctcaaagaatattccggggatgagcaggcgtccaagctctagactggatctccaccggcagcgcacgggaaggaaattttcttgagaatcaaataagaagcgcacagaaaacatgagaatttctttttcttgttcataatgttaataagtgctcccagacactacatatatcatactggatgaagtctacggaggtcttcggctaatgcttacttgatgtgtaagataaaaatattatatcttgttactgcatgagaagctgaagtaaatgatcccaaaaaaaaaaaa

SEQ ID NO: 9 - DNA, 3629 bp, Festuca arundinacea
agtagcctgcctgctcgccggcgagagatagctagggagggagggtaactagcgcaggaggagcctgctcgcctgccgtcgagatggcggcggggaacgagtggatcaacgggtacctggaggcgatcctggacgccgggtcgaagctgcggccgcagggcgtgcagctgccgccgctggagacggcgccggcgctcgcggccgaggagtccggcgccgcctacaaccccaccaggtacttcgtggaggaggtggtcaggagcttcgacgagcaggccctccacaagacatggacaaaggtggttgcgatgcggaacagccaggagcgcagcaaccggctggagaacctgtgctggaggatctggaacgtctccaggcagaagaagcaggtggagtgggattacacgaaagaggtggcccggcggaagcttgagcaggagctgggcagccgggaggccgccgaggacctctccgagctctccgagggcgagaaggataccaccaccgccaagcctgacgccgcaaccgctcaaccgtccaccgacgatggcgagcaccagcagccacaaccacgcacccggctcgcgaggatcaactccgaggtgcggctcgtctccgacgacgaggaggagcagaccaagaagaggaacctctacatcgtcctcatcagcatccatgggctggtgcgcggggagaacatggagctcggccgagactccgacaccggaggccaggtgaagtacgtggtggagctggcccgtgcgctggcggccacggcgggggtgcaccgcgtggacctgctgacgcggcagatctcctgccccgacgtggactggacctacggcgagccggtggagatgctggagcgcctgtcgtcggcggacgcggacgaggacgacggcgagcagtctggcggcggggcgtacatcgtgcggctgccgtgcgggcccagggaccagtacatccccaaggaggagctgtggccgcacatcccggagttcgtggaccgcgcgctctcgcacgtcaccgaggtggcgcgcgcgctaggcgaccagctccagcctcctcccactccggccgcgggcgacggcgcagccctagtggcagcgcccatatggccgtacgtgatccacggccactacgcggacgcggcggaggtggcggcgaacctggcgagcgcgctgaacgtgcccatggtcatgacgggccactcgctggggcgcaacaagctggagcagctgctcaagctgggccgcatgccgggccccgagatccagggcacctacaagatcgcgcgccggatcgaggccgaggagaccggcctcgacaccgcggagatggtggtcaccagcaccaagcaggagatcgaggagcagtggggcctctacgacggcttcgacctcatggtggagcgcaagctcagggtaaggcagcgccgcggcgtcagcagcctcggcaggtacatgccgcgcatggcggtcatcccgcccggcatggacttcagcttcgtcgagacacaggacacggctgagggggatggcgccgacctgcagatgctcattgcccccgacaaggccaagaaggctctgcctcccatttggtcggacgtgctgaggttcttcacgaacccgcacaagccgatgatcctggcgctgtcgcggccggacccgaagaagaacgtcactacgctgctcaaggcctacggcgagagccgccagctccgggagctcgcgaacctgactttgatactggggaacagggatgacatcgaggacatggccggcggcggcggcgcggtgctcacggcggtgctcaagctcatcgaccgatacgacctctacggccaggtggcctatccaaagcaccacaagcagacggacgtgcctcacatctaccgcctcgctgcaaagaccaagggagtattcaccaacccagctcttgtagagccgttcggcctcacaatcatcgaggctgctgcttacggtttgccggtggtcgcaaccaagaacggagggccggtggacatcctcaaggcgctcaacaacgggctgctggtggacccgcactcggcggaggcgatcaccggcgccctgctgagcctgctggccgagaagtcgcggtgggtggagtgccgccgcaacggcctccgcaacatccaccgcttctcgtggccgcaccactgccgcctctacctctcccacgtctccacctactgcgaccagccctcgccgcaccagcctctccgcgtgcccctcggcctgggctcctcgaccagcttcggcgcagacgactcgctctcggactcgctccgcggcctctcgctccagatatccgtggacgcctccagcgacctcaacgccgcggactccgcggccgccatcatggacgcgctccgccggcgcccggcctccgagaagccggcgagctccggtgccagggcgctcggcttcgcgcccggccggcgggagagcctcctggtggtcgccgtcgactgctacggcgacgacggcaagccggacgtcaagcagctaaagaaggccatcgacgcggcggtgtcggttggtgaatgcgcgggagctaagcaggggtacgtgctgtcgaccggcatgaccatccccgaggccgcggaggcgatcaaggcgtgcggcgccgacgttgccagcttcgacgcgctgatatgcagcagcggggccgagctatgctacccgtggaaggagctcgcggccgacgaggagtactccgggcacgtcgcgttccggtggcccggtgaccacgtgaaatccgccgtgcccaggctcgggagcttggaggagatcgccctcgcaatcgatcgccccgcctgctccgtgcactgccacgcctacgccgccacggacgcatccaaggtgaagaaggtggattcgatcaggaagtcgctgcggatgcgcgggttccggtgcaacctcgtctacacgcgcgcgtgcacgcgcctcaacgtcatccccctctccgcttcccggccgcgcgctctcaggtacctgtcgatacagtgggggatcgatctctccaaggtggcggtgctcgtcggcgagaccggcgacaccgaccgcgagaggctcctcccgggagttcacaagacgctcatcctgccgggaatggtcgcccgcggcagcgaggagctcctccgaggcgacgacgggtacaccatggcggacgtcgtggccatggactcccccaacattgtcacgctcgccgaaggccagtctgcctccgacctcctcaaggccatctgagagcgtgctctgctgctccctgtgctgcttctgttttccacatctgggacgcagtagcttcacttggattgtttcgcctgtgattttggcaggaagatgatgactgcagaattgcatttgcatataccgtatacctgtgcaagcatgagcaaaacatgtcagctaataattctttaatgttttggtcatgcctccgtgaggtatgcttgtgtgcattctataaaagaaaaacgcaagaatgaaagaaagaaatattttcaatgtaagttgatgtttcttcctgacggcttcttacttggattgtctacattaattgtttcaaggaaatacaaggatctcccctctccaaaaaaaaaa

SEQ ID NO: 10 - DNA, 3745 bp, Lolium perenne
gctccgatcccccacccacctcccaatttccccaagccgcatcgcatcacctcgtctcccgagagcaccgcgatggcggggaacgactggatcaacagctacctggaggccatcctcgacgcgggcggcaccgcgggggacatctcggccgcctctgtggccggaggcgatgatgggccgggcgctggcggaggcactgcgggggagaagcgggacaagtcgtcactcatgctccgagagcgcggccggttcaaccccgcgcgctacttcgtcgaggaggtcatctccggattcgacgagacggacctctacaagacctgggtccgcacgtcggccatgagaagcccgcaagagaggaatacgcggctggagaacatgtcctggaggatctggaacctcgctaggaagaagaagcagattgaaggtgaggaagcctcccgtttatcaaagaaacgtcttgaacgtgagaaggctcgtcgagatgctgctgctgatttgtctgaggacctatctgagggagaaaaaggagaaaacattaacggatcatctgttcacgatgagagcacaaggggacgaatgccaaggataggttcaactgatgctattgaggtgtgggcaaatcagcacaaagataaaaaactgtacatagtgctaataagtattcatggtcttatacgtggtgagaatatggagcttgggcgtgattcagatacaggcggtcaggtcaaatatgttgtagagcttgctagggcattaggtgaaacacctggagtatacagagtggatctgctgacaaggcagatttctgcacctgatgttgactggagttacggagaacctacagagatgctgagtccaagaaattctgagaaccttggggatgacatgggtgaaagcagtggtgcttatattgttaggataccttttggaccaagagaaaagtatatacctaaagagcagctctggccccacatacaggaatttgttgatggtgcacttgtccatatcatgcagatgtccaaggttcttggtgaacaagttggtcgtgaacggcgagtatggcctgttgttatccacggacactatgctgatgcaggcgattctgctgctctattatctggggcactcaatgtcccaatggtattcacaggtcattctcttggcagagacaaattagagcaacttttgaagcaaggacgtcaaaccagggacgaagtaaatgcaacatacaagataatgcgtcggattgaagctgaggaactttgtcttgatgcatctgaaattgtaattacaagcactaggcaagaaatagagaaacaatggggattgtacaatggatttgatgtaactatggagaggaaacttagagcaagaacaaagcgtggtgtcagctgctatggtcgttacatgcctcgtatgattgcgattcctcctggcatggagtttagccatattgtgcctcatgatgttgacctggatggtgatgaagcaaatgaagttggctcaggttcaccggatccacctatttgggctgatataatgcgtttcttctcaaaccctcgtaagcccatgattctcgctcttgctcggccagatcccaagaagaacatcactacattggtgaaggcatttggtgaacaccctggattgagaaatttagcaaaccttacactgatcatgggtaaccgtgatgttattgatgaaatgtcaagcacaaatggagctgttttgacctcagtactcaagttaattgacaaatatgatctatatggccaagtggcataccccaagcaccataagcaatctgaagttccagatatttatcgtttggcggcaagaacaaagggggtttttattaattgtgcttatattgaaccatttgggctcaccttgatcgaggctgctgcttatggtctaccgatggttgctacccaaaatggtgggcctgtcgacatacaccgggttcttgacaatggtatccttgttgatccacacaaccaaaatgatattgctgaggcactttataagcttgtttctgataagcacttgtgggcacaatgccgtcagaatggtctggataatatccatcgattttcttggcctgaacattgcaagaactatttgtcacgggttggcacggtgaagcctagacatccacgatggcaaaggagtgatgatgctactgaagtttctgaatcagattcacctggcgattctttgagggatgttcatgatatatctcttaacttgaagctttccttggacagtgaaaaagcaggcaccaagataaatactgaacgaaattccaccaatgccagaagaaatcttgaggatgctgtactaaaattttcaaatgctgttagtgagggcacaaaggatgagtctgatgagaatgctgaggccaccacaggctccataaatggccatctttacggagagaaacacattgttgttattgctgtagattctgtgcaaaatgctgacttggttcagattatcaaaaacctttttgaggcttcacgcaaagaaaaatcatctggtgctgttggttttgtactgtcgacatctcgagcaatatcagagacacttacttttttaacatctgggggcatacaaactactgaatttgatgccttcatatgcagcagtggcagtgatctttgttatccatcttcaagttcggaagacatgcttagccctaccgagcttccatttatgattgatcttgattatcactctcagattgaataccgttggggaggggaaggtttaaggaagacactaattcgttgggcagcagaaaacaacagtcagagtggacaagaagtagttactgaagatgaagaatgttcatccacttactgcatttcatttaaagtgaagaatactgaggctgtccctcctgtgaaggatcttagaaaaacaatgagaattcaagcactgcggtgtcatgtattgtacagccatgatggtagcaagttgaatcttatacctcttctagcatcacgatcccaagcactaaggtacttgtatatacgatggggggtagagctggcaaacatgacagtggttgttggtgaaagtggtgatacagattatgaagggctacttggaggcgtgcacaagaccatcatactcaaaggctcatttaatgctgctccaaaccagcttcatgctgccagaagctattcactggaggatgtcatatcgtttgacaaaccaggaattgcttcagtcgagggatatctcccagatagcttaaaatcagctctacaacagttcggtgtgctgaactaaagtgacaatcttgccatcagcagaacagttaagtagagtatctattctatgtggtccagatcgagaaatgtgcagcaaggcttgtcttcgctgttttaccacgtcttgcatggcagaataagttctggttgaggtttaccttctacaactcttcttgtaaaccaaaagaatttggagctacgaacttggatcagttttttgtccaaggcaaaactcaaggcaataatactgtgccctaccatcagtcacaataaagcaagattgaacatccttcttgagattcgttaatgttttgtaagactagtcatagtggggagtaatttatatgttgtttcatgcattgtattatttattatcttgtaaacccattttgttttggtgtgtgtgatgttattatggtaacatagctagttacccccctattatatttcttcactcaaaaaaaaaa

SEQ ID NO: 11 - DNA, 3735 bp, Lolium perenne
gcgcccgtgcgcacacgtatatagcccgatcaatatcaagttgggatctttagcgccggaggagcggagtagcctgctcgccggcgagggtaattagagcaagaggagtctgctcgccgtcaacaaagatggcggcggggaacgagtggatcaacgggtacctagaggcgatcctggacgcggggtcgaagctgcggccgcagggcgtgcagctgccgccgctggagacagcgccggcgctcgcggccgaggagagcagcgccgcctacaacccgaccaggtacttcgtggaggaggtggtcaggagcttcgacgagcaggccctccacaagacatggacaaaggtggttgcgatgcggaacagccaggagcggagcaaccggctggagaacctgtgctggaggatctggaacgtctccaggcagaagaagcaggtggagtgggattacacgaaagaggtggctcggcggaagcttgagcaggagctgggcagccgggaggccgccgaggacctatccgagctctccgagggcgagaaggacaccaccaccgccaagcccgacgccgcagccgctcaaccgtccgccgacgatggcgagcaccagcagccgcagccacgcacccggctcgcgaggatcaactccgaggtgcggctcgtctccgacgacgaggaggagcagaccaagaagaggaacctctacatcgtcctcatcagcatccatgggctggtgcgcggggagaacatggagctcggccgagactccgacaccggtggccaggtgaagtacgtggtggagctggcgcgtgcgctggcggcgacggcgggggtgcaccgggtggacctgctgacgcggcagatctcctgcccggacgtggactggacctacggcgagcccgtggagatgctggagcgcctgtcgtcggcggacgccgacgacgacgacggcgagcaggccggcggcggtgcctacatcgtgcggctgccgtgcgggccaagggaccagtacatccccaaggaggagctgtggccgcacatccccgagttcgtggaccgcgcgctctcgcacgtcaccgaggtcgcccgcgcgctcggcgagcagctccagcctcctccttctccggccgacggcgcggtggcggcgcccatctggccgtacgtgatccacggccactacgcggacgcggcggaggtggcggcgaacctggcgagcgcgctgaacgtgcccatggtcatgacgggccactcgctggggcgcaacaagctggagcagctgctcaagctcggccgcatgccgggccccgagatccagggcacctacaagatcgcgcgccggatcgaggccgaggagacggggctcgacaccgcggagatggtggtcaccagcaccaagcaggagatcgaggagcagtggggactctacgacggcttcgacctcatggtggagcgcaagctccgggtaaggcagcgccgcggcgtcagcagcctcggacggtacatgccgcgcatggcggtcatcccgcccggcatggacttcagcttcgtcgagacacaggacacggctgacgggacgggccgatctcagatgctcattgctcccgacaaggccaagaaggctctgcctcccatttggtcagacgtgctgcggttcttcacgaacccgcacaagccgatgatcctggcgctgtcgcggccggacccaaagaagaatgtcaccacgctgctcaaggcctacggcgagagccgccagctccgggagctcgcgaacctgacactgatactggggaacagggatgacatcgaggacatggccggtggcggcggcgcggtgctcacggccgtgctcaagctcatcgaccgatacgacctctacggccaggtggcctacccaaagcaccacaagcagacggacgtgcctcacatctaccgcctcgccgccaagaccaagggagtattcatcaacccagctcttgtggagccgttcggcctcacaatcatcgaggctgctgcttatggtttgccggtggtggcgaccaagaacggcgggccggtggacatcctgaaggcgctccacaacgggctgctggtggacccgcactcggcggaagcgatcaccggcgcgctgctgagcctgctggctgagaagtcgcggtgggtggagtgccgccgcaacggcctccgcaacatccaccgcttctcgtggccgcaccactgccgcctctacctctcccacgtctccacctactgcgaccagccctcgccgcaccagccgctccgcgtgcccctcgccctgggctcctccaccagcttcggcgccgacgactcgctctcggactcgctccgcggcctctcgctccagatatccgtggacgcctccagcgacctcaacgccgcggactccgcggccgccatcatggacgcgctccgccggcgcccggcatccgagaagccggcgagctccggtgccagggcgctcggcttcgcgcccggccggcgggagagcctcctggtggtggccgtcgactgctacggcgacgacggcaagcccgacgtcgagcagctgaagaaggccatcgacgcggcggtgtcggttggtgaatgcgcgggagcgaagcaggggtacgtgctgtcgaccggcatgaccatccccgaggccgcggaggcgatcaaggcatgcggcgccgacgttgccagcttcgacgcgctgatatgcagcagcggggccgagctatgctacccgtggaagaagctcgtggccgacgaggagtactccgggcacgtcgcgttccggtggcccggtgaccacgtgaaatccgccgtgcccaggctcgggagcatggaggagatcgccctcgcaatcgatcggcccgcctcctccgtgcactgccacgcctacgccgccacggacgcatccaaggtaagcataacagagcactacttgtagtaaccactaaccagcacggtacatggtctcctccatgcctaagcttctgatgcgtggggttttgggcaggtgaagaaggtggattcgatcaggcaggcgctgcggatgcgcggcttccggtgcaacctcgtctacacgcgcgcctgcacgcgcctcaacgtcatccccctctccgcttcccggccgcgcgctctcaggtacctgtcgatacagtgggggatcgatctctccaaggtggcggtgctcgtcggcgagaccggcgacaccgaccgcgagaggctcctcccgggagtgcacaggacgctcatcctgccggggatggtcgcccgcggcagcgaggagctcctccgaggcgacgacgggtacaccatggcggacgtcgtggccatggactcccccaacattgtcacgctcgcggaaggccagtctgcatccgacatcctcaaggccatctgagagcatgctctgctccttgtgctgcctctgttttccacatcccggacgcagtagctccacttcgattatttcacctgtgattttggcaggaagatgactgcagaattgcatttgcatataccgtatacctgtgcaagcatgagcaaaacatgtcagctaataattcttttatgttttggccatgcctccgtgaggtatgcttgtgtacatactataaaggaacagagagagaaacgcaagaatgaaagagagaaatattttcaatgtaagttgatgtttcttcctgacggcttcttacaatggcttgtctacattaattgtctcaagaaaaaaaaaa

SEQ ID NO: 12 - DNA, 2716 bp, Lolium perenne
gcttctcccctcacacgcctcgccatttgttttgtgtcctgagccatggctgccaagctgactcgcctccacagtctccgggagcgccttggtgccaccttctcctcccatcctaacgagctcattgccctcttttcaaagtatgttcaccagggcaaaggaatgcttcagcgccaccagctgctcactgagtttgaagccttgtttgaggctgacaaggagagatatgcaccctttgaagacattctccgtgctgctcaggaagcaattgtgctgcccccatgggttgcactggccatcaggcctaggcctggtgtctgggactacatacgggtgaatgttagcgagttggctgttgaggagctgacagtttccgagtacctggcattcaaggaacagcttgttgatgagcacgccagcagcaagtttgtgcttgagcttgattttgagcctttcaatgcctccttcccacgtccttccatgtccaagtccattggaaatggggtgcagttccttaaccgtcacctgtcttccaagctgttccaggacaaggagagcctctacccactactgaacttcctgaaagcccataaccaccagggcacgacaatgatgctaaacgaccgaattcagagccttcgtgggctccaatcagcccttagaaaggcagaagagtatctaacgagcattcctgaagacaccccgtcctctgagttcaaccacaggttccaagagcttggcttggagaagggttggggcgacaccgctaagcgtgtacaggacaccatccacttgcttcttgatctacttgaggcccctgatccagccagcttggagaagttccttggaactataccaatgatgttcaatgttgttatcctgtctccacacggatattttgctcaatccaatgtgttgggataccctgatactggtggccaggttgtgtacatcttggatcaagtccgtgctttggagaatgagatgcttctgaggattaagcagcaaggccttgacataacccctaagatcctcattgtcaccaggctgttgcctgatgctgttggaactacatgtggccagcggctggagaaagttattgggactgagcacactgacattctccgtgttccattcagaactgagaaggggatcctccgtaagtggatctctcgttttgatgtctggccatacctggagacatacaccgaggatgttgcaaacgaactcatgagagaaatgcagaccaagcctgatctcattattggcaactacagtgacggtaaccttgtcgccactctgcttgcgcataagttgggagttacccagtgcaccattgcccatgctttggagaaaacaaaataccccaactcagacatatatttggacaaattcgacagccaataccatttctcatgccagttcactgctgaccttattgccatgaatcacactgatttcatcatcaccagcacattccaggaaattgctggaagcaaggacagcgtgggccagtatgagtctcacattgctttcaccctccctgatctctaccgtgttgtccatgggattgacgtgttcgatcccaagttcaacattgtctctcctggagcagatatgactgtctacttcccatacactgaaactgacaagaggcttactgccttccaccctgaaattgaagagctcctttacagtgatgttgagaactctgaacacaagtttgtattgaaggacaagaacaagcctatcatcttctcaatggctcgtcttgaccgtgtgaagaacatgacaggcttggttgagatgtttggtaagaatgctcatctgaaggatttggcaaaccttgtgattgtcgctggtgaccatggcaaggagtccaaggatagggaggagcaggctgagttcaaaaggatgtacagtctcattgaggagtacaagctggagggccatatccggtggatctcagctcagatgaaccgtgttcgcaatgcagagttgtaccgctacatttgtgacaccaagggcgcatttgttcagcctgcattctatgaagcatttggcctgactgttgtcgaggccatgacatgtggtttgcccacaatagcgacatgccatggtggcccagctgaaatcattgtgaatggtgtgtctggtttgcacatcgatccttaccacagtgacaaggctgcagatatcctggtcaacttctttgagaaatccacggcagatccaacctactgggacaaaatgtcggaaggtggcctgaagagaatttatgagaagtacacctggaagctgtactcagagaggctgatgaccctgactggtgtatatggtttctggaagtatgtgagcaaccttgagaggcgtgagactcgccgttaccttgagatgttctacgctctgaagtaccgcagcctggctgctgcagttccattggccgtcgatggcgagaacacggacaattagtgcgggacatgaagaggcgccttcaaagggcgaggtgtcggctgcgttatgatttgattgtctaccggagttttcatttggtctattgtggagtgtgtacttggatgtctcaggcacttctgtgaggttttgggcagttctttgctggttcctgctagctgcatatgttgtcttcaataaacgcctgcccgtattgttcatctcttataattcaatgcaatcttctgttgcctaaaaaaaaaaa

SEQ ID NO: 13 - DNA, 2754 bp, Festuca arundinacea
gctggggttttgttgctcctgtctatttattatcccctctggatcttgagaaaccctccgccgtttggcttctcccctcgcccccttcaccatttgttttgtgtcctgagccatggctgccaagctgactcgtctccacagtctccgggagcgccttggtgccaccttctcctcccatcccaacgagctcattgccctcttttccaagtatgttcaccagggcaaaggaatgcttcagcgccaccagctgctcactgagtttgaagcattgtttgagtctgacaaggagaggtatgcaccttttcaagacattctccgtgctgcccaggaagcaattgtgcttcccccatgggttgcacttgccatcaggcccaggcctggtgtctgggactacataagggtgaatgttagcgagttggccgttgaggagctgacagtttccgagtacctagcattcaaggagcagcttgttgatgagcacgccagcagcaagtttgtgcttgagcttgattttgagcctttcaatgcctccttcccacgtccttccatgtccaagtccattggaaatggggtgcagttccttaaccgtcacctgtcttccaagctgttccaggacaaggagagcctctacccactactgaacttcctgaaagcccataaccacaagggcacgacaatgatgctaaacgacagaattacgagccttcgtgggctccaatcagcccttagaaaggcagaagagtatctaacaagcatccttgaagacaccccgtcctttgagttcaaccacaggttccaagagcttggcttggagaagggttggggtgacaccgctaagcgtgtacaggacaccatccacttgcttcttgatctgcttgaggcccctgatccagccagcttggagaagttccttggaactataccgatgatgttcaatgtcgttatcctgtctccacacggatattttgctcaatccaatgtgttgggataccctgataccggtggccaggttgtgtacatcttggatcaagtccgtgctttggagaatgagatgcttctgaggattaagcagcaaggccttgacataacccctaagatcctcattgtcaccaggttgttgcctgatgctgttggaactacatgtggccagcggctggagaaggttattgggactgagcacactgacattcttcgtgttccattcagaactgaaaaggggatcctccgtaagtggatatctcgttttgatgtctggccatacctggagacatacaccgaggatgttgcaaacgaactcatgagagaaatgcagaccaagcctgatctcattattggcaactacagtgacggtaaccttgtcgccactctgctcgcgcataagttgggagttacccagtgcactattgcccatgctttggagaaaaccaaataccccaactcagacatatatttggacaaattcgacagccaataccatttctcatgccagttcactgctgaccttattgccatgaatcacactgatttcatcatcaccagcacattccaggaaattgctggaagcaaggacagcgtgggccagtatgagtctcacattgctttcaccctccctgatctctaccgtgttgtccatgggattgacgtgttcgatcccaagttcaacattgtctctcctggagcagatatgagcgtctacttcccatacactgaaactgacaagaggcttactgccttccaccctgaaattgaagagctcctttacagcgatgttgagaactctgaacacaagtttgtattgaaggacaagaacaagccgatcatcttctcaatggctcgccttgaccgtgtgaagaacatgacaggcttggttgagatgttcggtaagaatgctcatctgaaggatttggcaaaccttgtgattgtcgctggtgaccatggcaaggagtccaaggatagggaggagcaggctgagttcaaaaggatgtacagtctcattgaggagtacaagctgaagggccatatccggtggatctcagctcagatgaaccgtgttcgcaatgcggagttgtaccgctacatctgtgacaccaagggcgcatttgttcagcccgcgttctatgaagcatttggcctgactgttatcgaggccatgacatgtggtttgccgacaatagcgacatgccatggtggcccagctgaaatcattgtggatggtgtgtctggtttgcacatcgatccttaccacagtgacaaggctgcagatatcctggtcaacttctttgagaaatccacggcggatccaacctactgggacaaaatgtcggaaggaggcctgaagagaatttatgagaagtacacctggaagctgtactcagagaggctgatgaccctgactggtgtatatggtttctggaagtacgtgagcaaccttgagaggcgtgagactcgccgttaccttgagatgttctacgctctgaagtaccgcagcctggcagctgcagttccattggctgtcgacggcgagaacaccgacagttagtgcagaggcgcctttcgcgggcaaagtattggctgcgttatgatttgtctaccgtagtttccatttggtctattatggggtgtgtaccttgatgttggggtgtgtaccttgatgtttggcactttcctgaggtttctgggcagtgctttgctggttcctgctagctgcatatgttgccttcaataaacgcctgcccatattgttcaaaaaaaaaa

SEQ ID NO: 14 - DNA, 2950 bp, Lolium perenne
ttcttcctcgtggtgcgttgcgtttgtcgggttcttctgaagaagcggaaggtttgagcaatgggggaagccgccggcgaccgtgtgctgagccgcctccacagcgtcagggagcgaatcggcgactccctctccgcccaccccaatgagctcgtcgccgtcttcaccaggctggtcaaccttggaaagggaatgctgcagccccaccagatcatcgctgagtacaacactgcaatccctgaagcagagcgcgagaagctcaaggacggcgccttcgaggatgtactgagggcagcgcaggaggcaatcgtcatctccccatgggttgcacttgccatccgccctaggcctggtgtctgggagtatgtgagagtcaacgtgagcgagcttgctgtcgaggagttgagtgtccctgagtacttgcagttcaaggaacagcttgtggaaggaagcaacaaagacttcgtgcttgagctggactttgagccattcaatgcctccttccctcgtccttccctgtcgaagtccattggcaacggtgtgcagttcctcaataggcacctgtcatcaaagctcttccatgacaaggagagcatgtaccctttgctcaacttcctccgtgcacacaactacaagggcatgcctatgatgatgaacgacagagtccgcagtctaagtgctctccagggagctctgaggaaggccgaggagcatctgtctggtcttccagcagacaccccgtactcggacttccaccacaggttccaagaacttggtttggaaaagggctggggtgattgtgccaagcgtgcgcaagagacccttcacctgctcctcgaccttcttgaggcacctgacccgtccacacttgagaagttccttggtacaatcccaatggtgttcaatgttgtcatcctctctccacatggttactttgcacaagccaatgtcttggggtaccctgacaccggagggcaggttgtctacattttggatcaagtccgtgctatggagaatgagatgcttttgaggatcaagcagcaaggactcgatatcacaccacggatccttattgttaccaggcttctccctgatgcaaccggtacgacctgcggtcagcgtcttgagaaggtcctcggtactgagcacacccacatccttcgtgtgccattcagaactgaaaatggaattgttcgcaaatggatctcacgttttgaagtctggccatacctggagactttcactgatgatgtggcgcacgagatttctggagagctccaggccaaccctgacctgatcatcggaaattacagtgatggaaaccttgttgcatgtttgcttgcacacaagatgggcgttactcattgtaccattgcgcatgcgcttgagaaaaccaagtaccccaactctgacctgtactggaagaagtttgaggatcactaccacttctcatgccagttcaccactgacttgattgcaatgaaccacgcggacttcatcatcacaagtaccttccaagagattgctggaaacaaggacaccgttggtcagtacgagtctcacatggcattcacgatgcctggaatgtaccgtgttgtccacggtatcgatgtttttgaccccaagtttaacatagtttcgcctggtgcggacatgtccatctacttcccgtactcagagtcacaaaggaggctcacctcactccacccagagattgaggagctgctctacagtgatgtcgacaacgatgagcacagttgtctgaaggacaggaacaagccaatcatcttctcgatggctcgtctggaccgtgtcaagaacttgactggtctggttgagctgtatggccggaaccctcgcttgcaggagcttgttaaccttgtggttgtttgtggtgaccatggcaacccatcaaaggacaaggaggagcaggctgagttcaaaaagatgtttgaccttattgaacagtacaacctgaatggccatatccgctggatctctgctcagatgaaccgtgtccgtaatgctgagctctatcgctacatctgcgacaccaagggtgcttttgtgcagcctgcattctatgaggctttcgggctaactgtcatcgaggccatgacctgtggtcttccaacatttgcaactgcatatggtggtccagctgagatcatcgtgaacggtgtctccggctaccacattgatccttaccagggtgacaaggcctcggctctgctcgttgagttctttgagaagtgccagggagaccacagccactggaccaagatctcactgggagggcttcagcgtattgaggagaaatacacctggaagctttactctgagaggctgatgaccctcaccggtgtctatggcttctggaagtacgtctccaaccttgagaggcgtgagacccgccgctacctggaaatgctgtacgcgctcaagtaccgcaccatggccagcactgttccattggctgtcgagggggagccctcgagcaagtgatctggccacctatcggccggaagaagaagaagaaggttggcttcgatttctgaaagatttgagatttgagaatgcgttggttttcttcctaggcgctgctcttttagagttaaggtcgagttgatgtgctagtttgattcagcagtgggagtgagttgagacagaaggatgtggtgtgtgccagtattgttggtgcttttcgtgttctttggatgttacccttgaataatagtagcggccttggcgccgtttctgaaataatagtagcatccttgctcgttgccaagaaaatcttagtttttttttctcttgaacaagtggcaaagcgacctctgcatctatctctgtcattgacatttagctctgttgcggtgcactggataccttacattgctctagagaacagcaataaaagccggaccatgtgattgctgtaaaaaaaaaa

SEQ ID NO: 15 - DNA, 2825 bp, Festuca arundinacea
gcgcgtttcccctacctgtgacgttcccgtgtttccccttccgggcgctctcgcctccttcttcctcagagcaaggtttgaggatccgactggaggatagcaatgggggagagtgcaggagagcgtgctctgagccgtctccacagcgtaagggagcgtatcggcgattccctctcagcgcacaccaatgagctcgtcgccgtcttctcaaggcttgttaaccatggaaagggaatgcttcagccccaccagatcactgctgagtacaatgctgctattcccgaggctgagcgagagaagctgaaggataccgcctttgaggatctcctaaggggggcacaggaggcaattgtcatccctccatgggttgctctcgccatccggccaaggcctggcgtctgggagtatgtgagggtcaatgtgagcgagctcggcgttgaggagttgagtgtccctgagtatttgcaattcaaggaacaattggtgaatgaaagcactgataacaactttgtgcttgagctggactttgggccattcaatgcctccttccctcggccatcgctgtcgaagtctattggcaatggtgtgcagttcttgaacaggcacctgtcatcaaagctgttccatgacaaggagagcatgtaccccttgctcaacttcctccgtgcacacaactacaaggggatgaccatgatgttgaacgacagaattcgcagtctcagtgccctccaagatgcactcaggaaggcagagaagcatctgtcaggccttccagctgacaccccgtactcagagttccaccaccggttccaggaacttggtttggagaaaggttggggcgactgtactcagcgtgcacacgagactattcaccttctcttggaccttctcgaggcccctgatccatccaccttggaaaagtttctcggaacaatcccaatggtgttcaatgttgtcatcctctctcctcatggttactttgctcaggccaatgtcttggggtacccagacactggtgggcaggttgtctacattttggaccaagtccgtgctatggagaatgagatgctattgagaatcaagcagcaaggtcttgacattacaccaaagattctaatagtcaccaggttgctccctgatgcacacggcaccacctgcggccagcgccttgagaaggtccttggcactgagcacacccacattctgcgtgtgccattcaaaacagaagatgggattgttcgcaaatggatctcacgttttgaagtctggccttacctggaagcttacaccgatgatgtggcacatgagattgctggagagctgcaggccaaccctgacttgatcattggaaactacagtgatggaaaccttgtcgcgtgtttgttggcacacaagttgggggttactcattgtaccattgctcatgccctagagaaaaccaagtaccccaactctgacctttactggaagaaatttgaggatcactaccacttttcctgccagttcacagctgacctgattgcaatgaaccatgctgacttcatcatcaccagtaccttccaagagattgctggaaacaaggatactgtagggcagtatgagtcgcacatggcattcacaatgcctggcctctatcgtgttgtccatggtattgatgtcttcgaccccaagttcaacatcgtctcccctggtgctgacatgaccatctacttcccatacactgaacaacagaagaggcttacctccctccatgctgagattgaggagctactcttcagtgatgtcgagaattctgagcacaaatttgtgctgaaggacaagaacaagccaatcatcttctcgatggctaggctggaccgtgtcaagaatatgactggcctggttgaactgtatggccggaacccacgcctacaggagctggtaaaccttgtggttgtctgtggagaccatggaaaagagtccaaggacaaggaggagcaggccgagttcaagaggatgtttgatcttatcgagcagtacaacttgagcagccacatccgctggatctctgctcagatgaaccgtgtacgcaacggtgagctctaccgctacatctgcgacatgaagggagcctttgtgcagcctgctttctatgaggccttcgggcttaccgtgatagaggccatgacatgtggcctccccacattcgccactgcatacggtggtccagctgagatcattgtgaatggcgtgtctggctaccacatcgatccataccagaatgacaaggcctctgcgctgctcgtggagttctttgagaagtgccaggaagacccaagccactggaacaagatctcgcagggcggactccagcgcatcgaggagaagtacacctggaagctgtactctgagaggctgatgaccctctctggtgtctatggtttctggaagtacgtctccaaccttgacaggcgtgagactcgtcgctaccttgagatgctctacgctctcaagtaccgcaaaatggctaccaccgttccattggctattgaaggcgagaccacaggcaaatgatttggcctcatcgaagaaataaaagggcggaccagcgccccactttcccattcctgattcagcattgaagcacagatcggagagttttatgcctttgcttttcctaggttgtagtttgagggaagttggttcccgtgagagtctctgtgttgtctgtggtagaggaactggatgtgagggatgtactcagtgctccggttggtactttttcatggatgctatgatttgaatgaataataagataagtctttgtttaccccccaaaaaaaaaa

SEQ ID NO: 16 - DNA, 1599 bp, Festuca arundinacea
gctggatcatacttgaacccgcaatagaaccggatacaccaggtgacataaaaggttgctggtccgcctcagccacagttatatctggtagtcaaccggtcatcatgtacaccggtggcgatgtagagaatcatcaggttcaaaacattgcgcttcctaagaaccggtctgacccgtaccttatagaatggaccaaggcatgcaataacccagtgctccaaccggttggaccaggaatgaacccaggcgagttcagggatccgacgacaggttggatcgggccggatggactatggagaatatcaattggagctgaggtgaacggttacagtgcagcacttttgtacaagagtgaagactttctgaattggagtagagttgatcacccactgtattcatccagtgcctccactatgtgggagtgcctggacttcttcgcggtattaccgggcagtaacggtggactggacctgtccgcagctattccgaaaggcgccaaacatgtcctcaaagtcagcgtggatcaatgtgacaagtacatgattggggtttatgatctcgaacatgatgcttttgtgcctgatactatcctcgatgaccgttggttgttgccgaggatcgattacggcaattactatgcttcaaaatcgttcttcgactcgaaaaataggaggaggatcatatggggttggactaatgagtcagatagttcttcagatgatgtcgcaaaaggctgggcaggtatctatgcaattcccaggacaatttggctagaccgtgatggcaagcagttgctgcaatggccagttgaagagattgagtcccttcgaagaaatgaaatcaactatcaaggactagatctggagaagggagatctttatgagattaagggagttgacactttgcaggctgatgtggagatagattttgagctgacgtctattgatgatgccgactcttttgatccttcctggcttttggatcccgaaaagcattgccgggaagcgggtgcatcagttcatggtggtatagggccatttggacttgttattctggccaccggcgacatggaggagcacactgttgtgcacttcagagtctacaaatcacagaaagaatacatgatactcatgtgctctgatataagaaggtcttccctgagacaaggactgtacgcacctgcctatggaggcttctttgaatttgatcttgaaaaggaaaggaagatatctctgagaactctaattgatcggtcggcggtggagagctttgggggcggtggcagggtctgtatcatagctagagtttatccagtggcgattgtcgatgacgggagtgcccacatgtatgccttcaacaatggaagtaccacggtcagggtgccacagatcagggcatggagcatgatgacagcacaagtgaatttaaagaaaggctgaagtgatgattaacacagaaaagctaattccttttattgattctttctcttattcatgagcactcattcgtacaaataaacggaaattcaacaggcatatgtaattgattgtttccttgatctcaattattcatatactataattattattaaaaaaaaaa

SEQ ID NO: 17 - DNA, 2010 bp, Lolium perenne
gctcgtcttcccctattaactgcgcatggggaatccgaaatgggtcctggcgccatgggcggtgctgcttctcctgcagctcgcctccgcatctcaccatgcccgcctgagcctggagacctcggccgcgtcgccgtcggtcccagcctccattgttagcccgctgctcaggacaggctaccacttccagccccccatgaactggatcaacgatccaaatgggccgttgtactacaagggatggtatcacctgttctaccagtacaaccccaagggcgcggtgtggggcaacatcatctgggcgcactcggtgtcccgcgacctgatcaactggatcgcccttgagccggcgatctcgccgaccatcccgacggaccagtacggcgtgtggtccggttcgacgacgatcctccacgacggcactccggcgatcctgtacacggggatcgaccggccgagcgtcaactaccagatccagaacatcgccctgcccaagaacgcgtcggaccctctcctccgggaatggtacaagccggggtacaacccgatcgcggtgccggtggaaggtataaacgcgacgcagttccgcgacccgaccaccgcgtggttcgccggcaggcactggcggatgctcgtcggcgggctgaggccgggcacgctccgcggggaggcgattctgtaccggagccgcgacttcaagcactgggtccgcgccaagcacccgctgcactcggcgctcaccggcatgtgggagtgcccggacttcttcccggtgggcaaggccggggtggagaagggcctggacacctccgagtacggcgcggcggcgggcgtggagaagcacgtgctgaagaacagcctcgacctcacccgctacgactactacaccatcggcacgtacgacaacgtcaaggagcggtacgtgccggacaaccccaccggcgacgtctaccagcgcctccagtacgactacggcaacttctacgcgtccaagaccttcttcgaccccgtgaagcagcgccggatcctcctggggtgggccaacgagtccgatagcgtggcccacgacaaggccaagggctgggccgggatccaggcgattcccaggaagatatggcttgaccccagcggcaagcagctggtgcagtggccggtggaggagctcgagaagctccggggcaagcctgtcaacgttggcgacaaggtcgtcaagcccggccagcattttgaggtcacgggcctgcagtcataccagtctgacgtggaggtgagcttcgaggtatcgagcctggataaggctgagcccttcgatccggcctacagcaacgacgcgcagaagctctgcggcatcaagggcgccgatgtcaagggcggggtggggccttttgggctttgggtgctgtcctctgccgacctagcagagaagactgcagtgttcttcagagtcttcaaggatggatacggcaaacctatcgtcctcatgtgcagcgaccccaccaagtcatctcttaccccagatctatacaagccgactttcgccgggttcgtcgacaccgacatttcgtccgggaagatctctctgagaagcttgatcgatcggtcggtggttgagagcttcggcgcgggagggaagacctgcatcctatcaagggtgtacccgtctatggccctagggaaagacgcgcaccttcacgtgttcaacaacggggagacggatatcaaggtgtccaagctgaccgcgtgggagatgaagagaccattgatgaatggcgcctaagcatgcaccatctccgacgagttttcgcttcctcgcatttcgtggtttcacttcactgatattcagtgcctcgattgctcactcaagagctctatgatcacatatgattgcaaattttgttgcaaaattcatgggttgggtaccgtggtgtacgtacaaataaagatattgtttaatttccacacgtctaaatataataatgaagagctagcttcatattttctaaaaaaaaa

SEQ ID NO: 18 - DNA, 1389 bp, Lolium perenne
gggcgtggggtccctgctggtgtaccggagcgcggacttcctccgctggcagcgcaacgccgcgccgctgcacgccagctcgcgggacgtgcccgtgctggagtgcccggacctgttcccggtggctgcggcggcgcagggcgcgacggaggggctcgagacttcggcaccgagcggcgccggggtgaggcatgtgctcaagctcacggacttcgccaaggaggaccactacatggttgggttttacgacgacgtggcggacaccttcgtgccggcggagcccgagcgcggcgacgaccccgacaactggcgccggctcgaccacggccacctgtacgcgtccaagtccttctacgacgcgcgcaacaagcggcgcatactgtgggcgtgggtggacgagaccgacggtggcggcgtcgccaggggctgggccggcatccaggcgttcccgagggcgatgtggctggacgccgacgggaagcggctggtgcagtggcccgtggaggagatcgagacgctgcggaggaagcgggtcggcctgcggtgggcgacggacgtggaggccggcggcaggaaggagatcgccggcatcgtgagctcgcaggcggacgtggaggtcgtgttcgagatcccgaacctggaggaggccgagacgttggaccccgagtgggtgctggatccgaaagggctgtgcgcggcgaagggcgcgtccgtgcacggcggcgtcggcccgttcgggctgctcgtcttggcctccggtgacctggaggagcacactgctgtgttcttcagggtgttcaagcacgatggcaagtacaaggttctcatgtgcaccgatctcacaaagtcatctacgaaagcaggggcacacaagccatcctatggagcatttcttgatgtggacgtggagaaggacaagttcatatcgctcagaacattgatcgatcacacggtggtggagagcttcggcgacggcgggaggacgtgcatgacggctcgtgtgtaccccgaacacgcggcgatgggaagcacccacctgtacgtgttcaacaacgggacaggtgccgtaaaggtgtccaaacttgaggcgtgggagctggcgacggcggccgtgaacggcggctcgcttgcacccgtcgtcgtcaaggcatccgaccctaaagaggccttgtagttttagggtatgcccgggatggtggctgcttagatgatgtccgtcgttgatttatgcttgttggtcgagttatgagtttcgggtaggatgatttatgcggaaatgcaattttagtggcgtcatgacctattggacaaacatctgtcattggaaaaacgtggtgatatgtccacgcccatatctaaaggtataatagaggcatcccaaaaaaaaaa

SEQ ID NO: 19 - DNA, 2231 bp, Festuca arundinacea
gctgtccactgcctctcgtcccacccgctctctctgttgctaagttggttggtttgccatggcgggcctccgtctcgccgcgtgcgcggccgtcgccgtgctactctgcctcctcctctcgtcctccgccgccctccgatggctctctgaccccgcgcctgagagcgccgccgccggagtcagccacgacagctaccggaccgcctaccacttccagcccacggagaactggcagaacgatccgaatgggccgatgtattacaagggcgtctaccacttcttctaccagtacaacccgtaccgcgcgacctggggcaacggcaacctctcctggggtcactccgtctccgtcgacctcgtaaactggtccgccctcgagaacgccatggacccggactcctccttcgacatcaacggctgctggtcgggctccgccaccatactccccgacggcaccccggtcttcctctacaccggcatcgacgccgacaacaaccaggtccagaacgtggccttccccaagaacgcctccgacccgctcctccgcgagtgggtgaagcccagctacaaccccgtcatcgcgctccccgacgacgtcgtgcacgacaacttccgggacccctccacggcctggctcggccgcgacggcctctggcgcgtcgccgtctccgcagggctcaaggacggcacggggaccacgctggtctaccgcagcaaggacttccggcagtgggagcgcaacgccgagccgctctactcgtcgagcgacgccggcatggtggagtgcccggacctgttccccctggcggagcccggcgaccagcacgggctcgactacacgccctcgaacggcgcggcggtgagttatgtgctgaagcagagcgttatggacacgctcagtgactactacgtgctggggcggtacgacgacgccgcggacaccttctcgccggtggaggcggacaacgactgccggacatggcagcgcttcgactacggccacgtctacgcgtccaagtccttctacgacgcgggcaagaagcggcgcgtgctctggagctgggccaacgagtccgaccccgaggccgactacctcgccaggggctgggccggcgtgcaggccgtcccgaggaggatctggctggacagcaaggggaagcagctgctgcagtggccgatcgaggagatcgagacgttgaggaagacgcgggtcgggttgctgggagcggagatgaacgccggcggcatgaacgagatcatcggcgtcgccggcgcgcaggcggacgtggaggtggtcttcgaggtcccgtccctggagggcgccgagaacctcgaccccaaccagctgcttgacccacagaggttgtgcggcgagaagggcgcgtccgtgcttggcggcgtcggcccgttcgggctgctcgttctggcctccggcgacctccaggagcacacctccgtcttcttcagagtgttcaggcacgagggcaagtacaaggttctcatgtgcaccgacctcagaagatcgactacgagagccgacgtgtacaagccgccgtacggagggttcgtggacatcgacatcgagaaggagaggagcatatcgctcaggacactggtcgaccactcggtggtggagagctacggcggcggcggccggacggtcatcacggcgcgggtgtacccggagcacgcggcgacgaccaacagccgcctgttcatgttcaacaatggcaccggcgccgtgaaggtgtccaagctcgatgcgtgggagctggcgccggcgaaagtgaacgtcccgggcgacgggctcatcaccgctggctcctcgatgcacctacgcgaagcgtattaggaggagattgtgattagtagttcgttcggtgaatggccaattgtgtggccgattggacttccctggccaaattacggtcttttgggggttcatttggggaatttgtagcagtgtctttcaggatagtaaagtacagtagtacgtagtaagaagggtagtcgaagtctcgaagagcgttttgctgatttgggatgcatttgggagatttgtttagtactgcatgtcagcgattgtgagtagtatctgtcaggatagtatataagtagtaagaaagaagagtagtcgaagagtggttgctgattaacacatgtcagcgaacagtccgcgtcttgtttattctttgcaaaagaaatagagaaagtacatatcaaaaaaaaaa

SEQ ID NO: 20 - DNA, 1319 bp, Festuca arundinacea
cttgaactcaactgagttcagggatccgacaactggttggatcggaccggatgggctatggagaatagcaattggtgctgagctgaatggctacggtgccgcacttttgtacaagagtgaagactttctgaattggactagagttgatcacccactgtattcagacaatgccccctcaatgtgggagtgcccagatttcttcgccgtattgccaggcaataacggtggactggacctgtctgcggcgatcccgaaaggcgccaaacatgtcctcaagatgagcgtggattactctgacaagtacatgattggggtttatgatctcaaacgtgatgcctttgttccggatgttgtcctagatgaccgtcggctgtggttgaggattgattacggcacattctatgcttcaaaatccttcttcgactcgaaaaggggcaggagggtcatatggggttggtccaacgagacagatagtgtttcagatgatggtgcaaaaggttgggcaggtatccatgcaatccccaggtcaatttggttagacagcgatggcaaacagttgctgcaatggccgattgatgagattgagtcccttcgaagagatgaaatcaaccatcaaggactagagctgaagaacggagacctatttgagattaagggaattgacactttgcaggctgatattgaagtagattttgagctgacgtccatcgacagcgccgatccttttgatccttcctggcttttggatgtcgagaggcattgccgggaagcaggtgcatcggttcaaggtggcatagggccatttggacttgttgtcctggcgtctgacaacatggaggagcacattgctgtgcacttcagagtttacaaatcacagaaaagccacatgatcctcatgtgctctgatctaagaaggtcttctctgagatcaggactgtacacaccagcctatggaggcttctttgaatttgaccttgaaaaggaaaggaagatatctctcagaactctgattgatcggtcagcggtggagagctttggcggcggtggcagggtctgcataacggccaggatttatccagtggcgcttgtcgacggcagggtccacatgtatgccttcaacaatggaagtaccacggtcagggtgccacaactcggggcatggagcatgatgacagcacaagtgaacgtgaataagggttgaagtgatggttaacacagaagagcagtttcattttcttaattagcgtactctcattcaggagcactccttggtacaattgaaaggaaattcgacaggaagtagttggtcaaaaaaaaaa

SEQ ID NO: 21 - DNA, 1995 bp, Festuca arundinacea
ggtcttccactaataactgcgcaagcaatggggaatccaaaatggatcttcgcgccatgggcggtgcttctgctcttcctcctgcagctcgcctgcgcatctcaccatacccgccggagcctggagaccgaggccgcgtcgccgtcagtaccagcttccattgttagcccgctgctcaggacgggctatcacttccagccccccatgaactggatcaacgatccaaatgggccattgtactacaagggctggtaccacctgttctaccagtacaaccccaagggcgcggtgtggggcaacatcatctgggcgcactcggtgtcccgcgacctcatcaactggatcgccctggagccggcgatcacgccgagcatcccgacggacaagtacggcgtgtggtccggttcgacgacgatcctccacgacgggacgccggcgatcctgtacacggggatcgaccggccgagcatcaactaccagatccagaacatcgcgctgcccaagaacgcgtcggacccgctcctccgggaatggtacaagcctgggtacaacccgatcgccgtgccagtggccggcatgaacgcgacgcagttccgcgacccgaccaccgcgtggttcgccggcaggcactggcggatgctggtggggggcctccggccggggacgctccgcggggaggcgatcctgtaccggagcctcgacttcaagaactggacccgcgcccaccacccgctgcactcggcgctgaccggcatgtgggagtgcccggacttcttcccggtgggcgaggccggggtggagaagggcctggacacctccgagcacggtgaaggggtggagaagcacgtgctgaagaacagcctcgacctcacccgctacgactactacaccgtcggcacgtacgacaacgtcaaggagcggtacgtgccggacaaccccaccggcgacgtctaccggcgcctccagtacgactacggcaacttctacgcgtccaagaccttcttcgaccccgtgaagcagcgccggatcctcctggggtgggccaacgagtccgacagcgtggcccacgacaaggccaagggctgggccgggatccaggcgattcccaggaagatatggcttgaccccagcggcaagcagctggtgcagtggccggtggaggagctggagaagctccggggcaagcctgtcaccgtcggcgacaaggtcgtcaagcccggccagcattttgaggtcacggggctgcagtcataccagtctgacgtggaggtgagcttcgaggtgtcgagcctggataaggccgagccgttcgatccggcctacagcaacgacgcgcagaagctgtgcgggatcaagggcgccgatgccaatggcggggtggggccttttgggctcgtggtgctggcctctgccgacctggcagagaagactgcagtgttcttcagagtcttcaaggatggatacggcaaacccatcgtcctcatgtgcagcgaccccaccaagtcatctctcaccccagatctatacaagccgactttcgccgggttcgtcgacaccgacatttcatccgggaagatctccctaagaagcttgattgaccggtcggtggttgagagcttcggcgcgggagggaaaacctgcatcctgtcaagagtgtacccgtccatggccctagggaaaaatgcgcaccttcacgtgttcaacaacggggagacggatatcaaggtgtccaagctgaccgtgtgggagatgaagagacccttgatgaatggcgcctaagcatgcaccatctccgacaagttttcggtttctcgcattttgtggttttagttcactgatgttcagtgcctcgattgctcgctcaggagctctatgatcagatatgattgcaaattttgttgcaaaattcatgggttgggtaccgtggtgtgtatgtacaaataaagatgttgtttaatttccacgcttctaaatataatagtaacaaaaaaaaaa

SEQ ID NO: 22 - DNA, 1760 bp, Lolium perenne
ggatggcttggtgacctttggaattctccggcaacacaaaagatccaaatggaccaatgtactacaatggtatctaccatgagttctaccagtacaaccccaatggctccctctggggtaacataatttggggccattcagtttcgacggacctcatcaactggatcccagtagaacctgcgatagaacgggatatcccaagtgacataaacggttgctggaccggctcagccacaattatttccggtgatcaaccaattatcatatacaccggagccgacaaggagaaccgtcagctccagaacattgtgcttcccaaaaacaagtctgacccgtatctgagggagtggacaaaagcaggtaataacccggtgatccaaccagtcgggccaggcttgaatgcgagccagttcagggatccgacaaccggttggattggaccggatggactgtggaggatagcagttggtgctgagcttaatggctacggtgctgcacttttgtacaagagtcaagactttctgaattggactagagttgatcacccgctgtattcatccaatgcatcctcaatgtgggagtgcccagattttttcgcggtattgccgggaaatagtggtggacttgacctatctgcagaaatcccaaatggcgccaagcatgtcctcaaaatgagcctagattcctgtgacaagtacatgatcggagtttatgatctgaaaagtgatacctttatgccagatagtgtgttagatgaccgtcgactgtggtcgaggatcgatcatggcaatttctatgcttcaaagtcattcttcgactcgaaaaagggaaggaggatcatatggggttggacaaatgagacagatagctcttcagatgatgttgcaaaaggttgggctggaatccatgcaattcccaggacaatatggttagacagttatggcaagcagttgctgcaatggccaattgaagagatcgagtcccttcgaagaaatgaaatcagccatcaaggactagagctgaagaaaggagacctatttgagattaaaggaactgacacttcgcaggtggtccatgtttttttagggaaactgtagcttatctggcacatcattttcttgaaacaggctgatgtggaggtagattttgagctgacatccattgataatgccgacccttttgatccttcctggcttctggatgtcgagaagcagtgccgagaagcaggtgcatcggttcaaggtggcatagggccatttggacttgttgtcttggcctctgacaacatggaggagcacactgctgtacacttcagagtttacaaatcgcagcaaagctacatgatcctcatgtgttctgatctaagaaggtcttccctgagatcaggaatgtacacaccagcatatggaggcttctttgaatttgaccttcagaaggaaagaaagatatctctgagaactctgattgatcggtcagcggtggagagcttcggaggcggtggcagggtctgcatcatggccagagtttatccggtggtgcttgtcgatgatggcggggcccacatgtacgccttcaacaatggcagtaccacggtcagggtgccacagctcagggcatggagcatgagcagggcagagcacaagtgaatgtaaagttaaagtgatgattaacatagaagagcaaatctaattgacctgtgattggaggactggaaaagtgatttaaatgcttagcacaattgtttcttgataaaaaaaaaa

SEQ ID NO: 23 - DNA, 2059 bp, Festuca arundinacea
ggaaccagccacccacctggccatccatggccgggctccgtctcgccgcggtcgccttccacctctgcctcctgctctctccgtcgtcctccctccgccggctctaccacgaggacgacgaggcagagagcacgccaggccatggcgggagcaggaccgcctaccacttccaacccgccaagaactggcagaacgatccgaatgggccgatgtaccacaacggcttgtaccacttgttctaccagtacaacccacgtggcgccacctggggcaacggcaacctctcctggggccactccgtgtccgtcgacctcgtcaactgggccgccctcgacaccgcccttgaccccgactccccgttcgacgccaacggctgctggtcgggatcagccaccatcctccccgatggacaaccggccattctctacaccggcatcgacgccgctggcaaccaggtccaaaacgtcgccttccccaagaaggcatccgatccactccttcgtgagtgggtgaagcctgactacaaccccgtcattcctctccccaaggacgtcgtgcacgacagcttccgtgacccctccacggcgtggcgcggccgtgacggcctctggcgtgtggccatcgcggccaaggtcaacgtgaccgtgaccgtggggtcaacactgatctaccggagcaaggacttccggcgctgggagaggaacgccgcgccgctgtacgagtctcttgccgccggcatggtggagtgcccggacctgttcccggtggcgaagcccggtgcgcagaacgggctcgactacgcgccctcgagcagggcggcgaggcacgtgctgaagctgagcgtggtggccacgctccaggactactacgtggtggggctgtacgacgacactgcggacaccttcaatgcggccgccggcgccgacaacgactggcggacctggcgccgcatcgactacggccacgtgtacgcgtccaagtccttcttcgacgcgcgaaagaaccggcgcgtgctttggtgctgggccaacgagtctgacaccgaggccgactacatcgccaggggttggtctggcgtccagacggtcccgaggaagatctggctggacatcgatgggaagcagctgctgcagtggccgatcaaggagatagagacgctgaggaagaagcgggtcgggttgctaggaacggagatgaactctggcggcctgaacgaaatcatcggcgtcgcgggctcgcaggcggacgtggaggtcgtcttcaagatcccgaccctggagggggctgagaacattgagcccaatgagctattggacccgcaaaagctatgcggcaacaatggcgcgtcaatgcggggcagtatcggcccgttcggtctactcctcctagcctccggcgacctgctggagcacacctcagtcttcttcagggtgttcaagcacggtgccaagtacaaggttctcatgtgcaccgacctcacaagatcgactacgagatccgacgtgtacaagccgtcgtacggagggttcgtggacatggacatcgacaagaccaagagcatatcgctcagaacattgattgatcactctgtggtggagagcttcggcggtggggggcgaacgtgcatcacggcgcgggtgtacccggagcacgcggagatgagcaacagccacatctatatgttcaacaatgggacaggcgcggtgaaggtagccaagctcgaggcgtgggagctggcgacagccaacgtgaatgtcgcgggccacgggtgataaccccaagtgcaatgaatagtcgtaacacgtttcagtgtggaagtgttagtataaaactgtgggagctactaggttttattctcgaaaactatatatgccacttatataactacttaattaggatatgcttctgcaaaaaaaaatcttcaaaaattggtccaagttaaagttgggggcggtgcccccgacatacacattcctctgcatatgcttgtaacgtgggtagaaaggtcaataagtacgcgggactttgtgattctcgccataggcataaaaaaaaaaaa

SEQ ID NO: 24 - DNA, 2167 bp, Lolium perenne
gggaccttgcgcccaagtacgtagtctgcacagcaatgggggttcgtctcgggagagtagcttgggcgtgcccggcggttctggtgctgctcttgcagctcgccggagcgtcccatgtcgtctacgagaccagcctcctcgagaccgaggcggcggcggccaccgtgccagcctccatttttgagctgagcaccgggtaccacttccggcctcagaagaactggatcaacgatcccaacgcgccgctgtactacaagggttggtaccatctgttcttccagtacaaccccaagggcgcggtgtggggcaacatcgtgtgggcgcactcggtgtcgcgcgacctcatcaactgggtggccctggagacggccctggcgccgagcatcgacgccgacaaatacggctgctggtcggggtcggcgaccatcatgcccgacggcacgccggtgatcatgtacacgggcgtcagccggccggacgtcaactacgaggtccagaacgtcgccttccccaagaacagctcggaccctctcctccgggagtgggtgaagccggcgcacaacccggtgatcgtcccggagggcggcatcaacgcgacgcagttccgggacccgaccacggcctggtacgcggacgggcactggcggatcctggtgggcgccctctccggcgcgtcccgcggcgtggcgtacgtgtaccggagccgcgacttccggcggtggacgcgggtgcggaagccgctgcactcggcgccgacggggatgtgggagtgcccggacttctacccggtgaccgtggacggcaaggagagcggggtggacacgtccgtggtgtccagctcgagggtgaagcacgtgctcaagaacagcctcgacctccgccgctacgactactacaccgtcgggacctacgaccggctgaaggagaggtacgtgccggacaaccccgccggcgacaagcaccacctgaggtacgactacggcaacttctacgcgtccaagacgttctacgacccgtccaagcgccgccgcatcctgtggggatgggcgaacgagtccgacaccgccgtcgacgacgtcgccaagggctgggccggaatccaggcgattcctcggaaggtttggctggacccaagcgggaggcagctgatgcagtggccggtggaggaggtgaaggcgctcagggggaagaagccggtcagcctcaaggaccggatggtgaagcggggagaacacgtcgaggtcaccgggctacaaaccgcacaggctgacgtcgaggtgagcttcgaggtgccgagcctggagggggcggaggcgctggacccggcgctggccaacgacgcccagaagctttgcggcgtgaagggcgccgacgtggagggcggcgtggggcccttcggtctgtgggtgctggcgtcgtccaagctggaggagaggaccgccgtcttcttcagggtgttcaaggccgcgggcaacgtcaacagcaccaagcccctcgtgctcatgtgctccgatccaaccaagtcatctctgaacaagaacctgtaccacccgaccttcgcgggcttcgttgatattgacatggctaagggcaagatttctctcagaagcctgatcgatcaatccgtcgtggagagctttggggccggaggcaggacgtgcatcctctctcgcgtctacccgtcgctcgccattggcaggaacgctcacctccacgtcttcaacaacggcaaggcggacatcaaggtgtcgcggctcacggcgtgggaaatgaagaagccggcgctcatgaacggtgcctagatttagattcaggcaggagcaccatatgcatgattcctacatatgtgcttgaatttggctcaggcatgcgtctggggcgttattctgatgttaatttgacctctggtgaaacatgctagttttacaagggcgcgtacgtagctagctaggtttgcacgctgtgtaagtgaagggggtcattttgtatgcccccgggaataataaagatccatgcatagcctgaggtgggcatcggtagaaagttatttttttgaaacggggcaaaatatttgctccaatcaactactcctggcatggattaaaataaggagcaacaaagtagaagttttacaagaaagttaatgttttgattattaaaaaaaaaa

SEQ ID NO: 25 - DNA, 2138 bp, Lolium perenne
gccctcgcactagtcggccgaggcattcttcctagttgcttccatcgcatcgatctcgatccacagattctatgccaatggaggcaagagatggcgtctcgatgccctactcgtatgcggccctgccggaggacgccgaggcagcggtggttgggcgcggtcgccggaccgggcctctgttcgcagcgttgctgttgacgttggtcgccgcgctccttgccgtcgccgcgctggctggcgtcaggctcgttggcgagctgcctgccgggggcgtcgtcatgcccaaccacccgatggaagtcatggacgtcagcggtagcagagggcctgagtcaggcgtgtcggagaagacgtccggggccgccagcgagagcggcggcatgctgggcgccgacgccggcagcaacgcgttcccgtggagcaatgcgatgctccagtggcagcgcaccggcttccacttccagcccgagaagaactggatgaacgaccccaacggtccggtctactacaaggggtggtaccacctcttctaccagtacaacccggagggcgcaatctggggcaacaagatcgcgtggggccatgccgtgtcccgggacatgctccggtggcgccacctgcccatcgccatgttccccgaccagtggtacgacatcaacggcgcatggtcaggctccgccaccgtgctccccgacggccgcatcgtcatgctctacacgggctccaccaacgcctccgtgcaggtccagtgcctcgccttcccctccgacccctccgacccgctgctcaccaactggaccaagtatgagggcaacccggtgctgtacccgcctccgcacgtcggggagaaggacttccgggacccgaccactgcatggtacgatggctccgatggaatgtggcggatcgtcatcgggtccaaggataaccgccgcgccggcatggccttgacctacaagaccaagaacttccatgattttgagctcgttcccggagtgctgcaccgggtgccggcgacggggatgtgggagtgcatcgatttgtacccggttggcggcgcgaggggcattgacatgacggaggccgttgcggcggcatccaacagcggtggtggtgaagttttgcatgtcatgaaggagagctcagacgacgaccgacatgactactacgcgctagggaggtacgatgcagcgacaaacaagtggacaccgctagatgccgacgccgatgtcggcatcgggctgaggtacgattggggaaagttctacgcatccaagaccttctatgacccggccaagaagaggcgtgtgctatgggggtgggtcggcgagactgactctgagcgcgccgacgtggccaagggatgggcttccctacagtcgatccctcgcacggtggtgctagataccaagacgggcagcaaccttatccagtggccggtggtcgaggtggagacgctccgtaccaactccaccaatctcgggagcatcatcgtcgagcatggctccgtcttccctctcagtctccaccgggccacacagctcgacatcgaggcttccttccgcctggacccgctcgatgtcgccgccgcaaaggaggccgacgttggctacaactgcagcaccagcggtggcgcggccggtcgtggagcgctcggtccctttggcctgctcgtactcgccgatgccaggcgccatggcggggacacggagcagaccgccgtctacttctacgtcgcgaggggcctcgatggcaacctgcgcacgcacttctgccatgacgagtcacggtcatcccgtgccaacgacattgtcaaaagggtcgttggcaacatcgtgccagtgctcgacggaaaggcgctgtctgttagggttttggtggcccactccattgtcgagagcttcgcacagggtgggaggtcggtggtgacttcacgagtttacccgactgaggccatctacgccaatgccggggtataccttttcaacaacgccaccggtgcccgggtccccgccaccagtctcgtcgtccataaaatggacccctcctacaaccagaaccaggccgaaatggcttcattgtaaatcgaaaatgtacatattgttttttgtgctagcatgttgcccgtaaaaaaaaaa

SEQ ID NO: 26 - DNA, 1768 bp, Lolium perenne
ggtccattggcgccacctcccgctcgccatggtgcccgaccaatggtacgacatcaacggtgtctggacaggctccgccaccgtgttccccgatgggaccctgaacatgctctacacggggtccaccaatgcctccgtgcaggcccagtgcctcgccgtgcccgaggaccccaatgactccctcctccgcaactggaccaagcacgaagccaacccggtcctcctcccaccgcccgggatcggtgacaaggacttccgtgacccaaccaccgcatggttcgacgagtctgaccagacgtggcgcaccgtcatcgggtccaaggacaacaacggccacgccggcatcgccatggtgtacaagaccaaagacttcctcaactacgagctcatcccgggatacttgcatcgcgtcgacggcaccggcatgtgggagtgcatcgacttctaccccgtcggcggcaagaacggcagcgaggagctgtacgtgatcaaggagagcagcgacgacgaccgacatgactggtacacgctagggaaatacgacgcggcagccaacacgttcacggccgcggacccggagaacgacctagggattgggctgaggtacgactggggcaagttctacgcgtccaagaccttctacgacccagccaagaagcggcgcgtgctgtgggggtggattggcgagaccgactccgagcgcgccgatgtcgccaagggatgggcatccctcatgtcgattccgaggacggtggagctcgacgagaagacctggaccaacctcatccaatggccagtggaggagatcgagaccctccgcatcaagtccaccgaccttggtggcatcaccattgaccacggcagcgtctacccactccctctccaccgcgccacacagctagacatcgaggcctccttccgcctcgacgccgccaccgtcgccgccctcaacgaggctgacgtaggctacaattgcagcaccagcggcggctctacccaccgcggcgcactcggcccctttggcatcctcgtccttgccgacggtaaggcggagcaaacggcggtgtacttctatgtgtccaagggccttgacggggccctcgagacccacttctgccacgacgagtcgcgatcgacgctggccaaggatgtcgtgaagcgagtggtgggatacaccgtgcctgtcctcgatggtgaggcattttccgtgagggtgctcgtggaccactcaattgtggagagcttcgccatgggtggaaggtccacggcgacgtcgagggtgtacccgacggagtctatctacggcgctgctggtgcatatcttttcaacaatgccaccggcggctccgtgaccgttgagaagctcgtggtgcatgagatggactcgtcctacaaccagatcttcatggctgacgacttgtagtcaccgtcatccatggatagcgtcggatggtgaggatgatcacctactacatatacatacatactattgatcgaacgatccccggatcggtcggtggtggcttcctctttttttggatgcagaaggagatggagtactagctactctatttaccatgttgttgttttgttggttttttggggtttgggtttttgacgagatggatgaattagctatagatggatgattgtgtcctatttttctcctgccttccgagtgtaactacatatattggcaggatcgatgatatccctgttgcatgacagtgatgattaattattgtgatgatattgatcaaaaaaaaaa

SEQ ID NO: 27 - DNA, 1855 bp, Lolium perenne
ggatcttccggtccaggctcccggacatcgacatccctacccacatgcccctgcacgactactgcttcgcgacggcagcctcggccccggacgcgccgtgcctcattaccgcagccacggggcggacctacacgttcgccgagacgcacctgctctgccgcaaggccgcggcggcgctgcacgggctcggcgtgcgccacggggaccggatcatggtgctgctgcagaactccgtggagttcgcgctcgccttcttcggcgcgtccatgctcggggccgtcagcacggcggcgaacccgttctgcacgccgcaggagatccacaagcagctcgtggcctccggcgcgaagctggtcgtcacgcagtccgcctacgtcgacaagctccggcacgaggccttcccacgaatcggcgaggccctgaccgtgatcaccatcgacgacgacggcaccccggacggctgccagccgttctggggcctcgtgtcagccgccgacgagaacagcgtcccggagtctcccatctcgccggacgacgcggtggcgctgccctactcgtcgggcacgacggggctgcccaagggcgtggtgctgacgcacgggggcctggtgtcgagcgtggcgcagcaggtggacggcgagaacccgaacctgcacatgcgggcgggggaggacgtggtgctctgcgtgctgccgctcttccacatcttctcgctcaactcggtgctgctgtgcgcgctgcgggcgggcgccgccgtgatgctgatgcctaggttcgagatgggggccatgctggagggcatcgagcggtggcgcgtcacggtggcggccgtggtgccgccgctggtgctcgcgctcgccaagaaccccggggtggagaagcacgacctcagctccattcggatcgtgctctccggcgccgcgccgctcggcaaggagctcgaggacgcgctacgtggccgcctgccgcaggccatcttcggacagggctacgggatgacggaggccgggccggtgctgtccatgtgcccggcgttcgcgcgggagccgacgccggccaagtccggctcctgcggcacggtggtgcgcaacgccgagctcaaggtggtcgaccccgacaccggcgtctccctcggccgcaacctccccggcgagatctgcatccgcggcccgcagatcatgaaaggatacttgaatgatcccgtggccaccgccgcgaccatcgacgtcgagggatggctccacaccggcgacatcggctacgtcgacgacgacgacgaggtcttcatcgtcgaccgcgtcaaggagctcatcaagttcaagggcttccaggtaccgccggccgagctcgaggctctgctcatcgcgcacccgtccatcgccgacgcggccgtcgtcccgcaaaaggatgatgccgccggcgaggtcccggtcgccttcgtggtccgcgccgccgactccgacatcgccgaggaggccatcaaggagttcgtatccaagcaggtggtgttctacaagaggctgcacaaggtctacttcacccacgcgatccccaagtcggcgtcggggaagatactcaggaaagaactcagagctaaactcgccgccccggccactgcctgaagagtggttcaaggcttcatgctaatcatttcgatcagaaaggcagttcctatgttccaccttttgtttcatttggaagattgtattccagctagtggccagtgactgagtaagggatggggataaaagttttgtctacgttttcttttacgctactctctccattgaggagtacaatgtatcaggggattcgtgattgaaattaatcaagattggttcaattaaaaaaaaaa

SEQ ID NO: 28 - DNA, 2041 bp, Lolium perenne
gaggaggtggtggaggagcacgaaatcccggccgccattcctccaccttccgctccgaccaaagatttccatccggcgagatccatgggctccatcgcggcagacttggcgccggaggcgcccgcggagctggtgttccggtcgaagctcccggacatcgagatcccgacccacctgacgctgcaagactactgcttcgagcgcctgccggagctctccgcccgcgcctgcctcatcgacggcgccacgggcgccgcgctcacctacggcgaggtggacgccctctcgcgccgctgcgcggccgggctgcgccgcctcggcgtccgcaagggcgacgtggtcatggcgctcctccgcaactgccccgagttcgccttcgtgttcctcggcgcggcccggctcggcgccgccaccaccaccgccaacccgttctacacgccccacgagatccaccgccaggccgccgcggccggcgccaaggtgatcgtcaccgaggcctgcgccgtcgagaaggtgcgcgccttcgccgccgagagagggatccccgtcgtctccgtcgacgaggccgtcgacgacggctgcctcccgttcgccgcgactctcctcggggaagaaagcggcgagcggttcgtcgacgaggcggtcgaccccgacgacgtggtggcgctgccgtactcgtccggcaccaccggcctgcccaagggcgtcatgctcacccaccgcagcctcgtcaccagcgtcgcccagcaggtggacggtgagaacccgaacctgcacttcagctcgtccgacgtgctgctgtgcgtgctgccgctgttccacatctactcgctcaactcggtgctgctcgccggtttacgcgccgggtgcgcgatcgtgatcatgcgcaagttcgaccacggcgctttggtggacctggtgcgcgcgcacggcgtcacggtggcgccattcgtgccgcccatcgtggtggagatcgccaagagcgcgcgggtgaccgccgcggacctggcgtcgatccggctggtcatgtcgggggcggcgcccatgggcaaggagctgcaggacgcgttcatggccaagatccccaacgctgtgctcgggcagggatatgggatgaccgaggccggccccgtgctagccatgtgcctggccttcgccaaggagccgttcgaggtcaagtctggctcctgcggcaccgtcgtccggaacgccgagctcaagatcgtcgaccccgacaccggcgcctccctcggccgcaacctgccgggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccagcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggattccattccaaagagtccatctggcaagatcctcaggaaggacctgagagcaaagctcgccgcaggcattcccggcagtgataccacacagtccaaaaactaagtcagatatattgtttcccaaccgtacacacctctgtccaacaccatgtaatgttcttaatataaacggaaattattacatatagaagggctgattctttttactagatgtgtccaacatatgatatgtttgttaggccgatgatgggtaacctgtcatgtatagataaccgcctttttttgataagaaaggctgattataatgtataccatgagctgaatatttgttcaagaagatcaggattcggttgccaattgtttaccttttaaaaaaaaaa

SEQ ID NO: 29 - DNA, 1934 bp, Festuca arundinacea
gggagcacggaatcccggccgccattcctccaccttcagctccggccaaagatttccatccggcgagatccatgggctccatcgcggcggacgcgccggaggcgcctcccgccgagctggtgttccggtccaagctcccggacatcgagatcccgacccacctgacgctgcaggactactgcttccagcgcctgccggagcactccgcgcgcgcctgcctcatcgacggcgccaccggcgccgcgctcacctacggcgaggtggacgcgctctcccgccgttgcgcggccggcctccgccgcctgggggtccgcaagggcgacgtcgtcatggcgctgctccgcaactgcccggagttcgccttcgtgttcctcggcgccgcccggctcggcgccgccaccaccaccgccaacccgttctacacgccccacgagatccaccgccaggccaccgccgccggcgccaaggtgatcgtcaccgaggcctgcgccgtcgagaaggtgcgcgcgttcgccgccgagagagggataaccgtcgtctccgtcgacgagggcgtcgacgacggctgcctcccgttcggcgagactctgctcggggaagacggcggcgagcggttcgtcgacgaggcggtcgacccggacgacgtggtggcgctgccgtactcgtccggcaccaccggcctccccaagggcgtcatgctcacccaccgcagcctcgtcaccagcgtcgcccagcaggtggacggtgagaacccgaatctgcacttcagctcgtcggacgtgctgctgtgcgtgctgccgctgttccacatctactctctcaactcggtgctgctggcggggctccgcgcgggttgcgcgatcgtgatcatgcgcaagttcgaccacggtgcgctggtggacctggtgcgcgcgcacggcgtcaccgtggcgccattcgtgccgcccatcgtggtggagatcgccaagagcgcgcgggtgacggcggcggacctggcgtccatccggctggtcatgtcgggggcggcgcccatgggcaaggagctgcaggacgcgttcatggccaagatccccaacgccgtgctcgggcagggatatgggatgaccgaggccggccccgtgctggccatgtgcctggccttcgccaaggagccgttcgaggtcaagtccggctcctgcggcaccgtcgtccggaacgccgagctcaagatcgtcgaccccgacaccggcgcctccctcggccgcaacctgcccggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccggcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggactccattccgaagagtccttctggtaagatccttaggaaggacctgagagcaaagctcgccgcaggcatccccggcagtgaaaccacacagtccaaaagctaagtcagatatattgtttcccaaccttacacacctctgtccaacatcatgtaatgttcttaatataaatggaaattaatacatatagaagggctgattctttttactagatgtccattgatatatttttagtccgatgatgtgtaccctgtcatgtatagataccgcctttattgaaaaaaaaaa

SEQ ID NO: 30 - DNA, 2014 bp, Lolium perenne
ggagagaggagatcaagcaagccatctcccacgactaatttagaagaagatttacttagtctctgcttctcgctcgatcgccggccggtgaggtagctagctagctactcgtactagatcattaccatgggttccgtgccggaggagtcagtggtgtccgtggccgcggcggagacggtgttccggtcgaagctccccgacatcgagatcaacaacgagcagacgctgcagagctactgcttcgagaagatggccgaggtcgcgtcccgcccctgcatcatcgacggccagacgggcgcctcctacacctacacggaggtcgactacctgacccgtcgcgccgcggcggggctgcgccgcatgggcgtggggaagggcgacgtggtgatgaacctgctccgcaactgccccgagttcgccttctccttcctgggcgcggccaggctgggcgccgccaccaccaccgccaacccgttctacaccccgcacgagatccaccgccaggcggaggcggcgggcgccaagctgatcgtcaccgaggcctgcgccgtggagaaggtgctggagttcgcggcggggcggggcctgcccgtggtcaccgtcgacgggaggcgcgacgggtgcgtggacttcgcggagctgatcgccggcgaggagctgcccgaggcggacgaggccgggatcctccccgacgacgtcgtcgccctgccctactcctccggcaccaccgggctccccaagggcgtcatgctcacccaccgcagcctcgtcaccagcgtcgcccagctggttgacgggtcgaacccaaacgtgtgcttcaacaaggacgacgcgctgctgtgcctgctgccgctgttccacatctactcgctgcacacggtgctgctggcggggctccgcgtcggcgccgccatcgtcatcatgcgcaagttcgacgtcggcgcgctggtggacctcgtccgcgcgcaccgcatcaccatcgcgccattcgtgccgcccatcgtcgtggagatcgccaagagcgaccgcgtcggcgccgacgacctcgcatccatccgcatggtgctctccggcgccgcgcccatgggcaaggacctccaggacgccttcatggccaagatccccaacgccgtgctcggacagggttacgggatgactgaggccgggccggtgctggccatgtgcctggcgttcgccaaggagcccttcaaggtcaagtccgggtcgtgcggcaccgtggtgcgcaacgcagagctcaaggtcgtcgaccccgacaccggcgcatccctcggcaggaaccagcccggcgagatctgcgtccgcgggaagcagatcatgataggttacctgaacgacccagagtctaccaagaacaccatcgacaaggacggctggctgcacaccggagatatcggcttggtggacgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgagatcaagcaattcgtctcaaaggaggttgttttctacaagaggatcaacaaggtctacttcaccgactccattcccaagaacccttccggcaagatcgtaaggaaggacttgagagccaggctcgccgctggcatccccaccgaagttgccgcgccgagaagctaagggccgcttctcaggaacgcaatcacccatggtgctgtttaggtgctgttatagaccacaccaaatggggaaagaaactacgggaggggatcatattattcttgcaggagatatcagtttgttgattcgccctgcttgtgtaatgttgataaaatgaaatgatagaatagatgtgttgttttattttttgaccatgtaaaaaaaaaaaaaaaaa

SEQ ID NO: 31 - DNA, 2073 bp, Festuca arundinacea
gagcaagcgcgcgcacgcactcgcaccatctcccacgactaatttaaccaccttacaagaagatttccttagtctccgtttctctctcgatcgccggccggtgaggtagctagctagctactcgtagatcattaccatggggtctgtgccggaggagtcagtggtagccgcggccgtggcggagacggtgttccggtcgaagctccctgacatcgagatcaacaacgagcagacgctgcagagctactgcttcgagaagatggccgaggtcgcatcccgcccctgcatcatcgacgggcagacgggcgcctcctacacctacacagaggtggagtccctgacccgtcgcgccgcggcggggctccggcgcatgggcgtggggaagggcgacgtggtgatgaacctgctccgcaactgccccgagttcgccttctccttcctgggcgcggcgcggctcggcgccgccaccaccaccgccaacccgttctacaccccgcacgagatccaccgccaggcggaggcggcgggcgccaaggtgatcgtcacggaggcctgcgccgtggagaaggtgctggagttcgcggcggagcggggactgcccgtggtgaccgtcgacgggaagcgcgacgggtgcgtcgacttcgcggagctgatcgccggcgaggagctgcccgaggcggaggaggccgggatcctccccgacgacgtcgtggccctgccgtactcgtccggcaccaccgggctccccaagggcgtcatgctcacccaccgcagcctcgtcaccagcgtcgcccagctgtttgacgggtcgaacccgaacgtgtgcttcaacaaggacgacgcgctgctgtgcctgctgccgctcttccacatctactcgctgcacacggtgctgctggcggggctccgcgtcggggccgccatcgtcatcatgcgcaagttcgacgtcggcgcgctggtggacctcgtccgcgcgcaccgcatcaccatcgcgccattcgtgcccccgatcgtggtggagatcgccaagagcgaccgcgtcaccgccgacgacctcacatccatccgcatggtgctctccggcgccgcgcccatgggcaaggacctccaggacgcgttcatggccaagatccccaacgccgtgctcggacagggttacgggatgactgaggccggtccggtgctggccatgtgcctggcgttcgccaaggagcccttcaaggtcaagtccgggtcctgcggcaccgtggtgcgcaacgccgagctcaaggtcgtcgaccccgacaccggcgcatccctcggccggaaccagcctggcgagatctgcgtccgcgggaagcagatcatgataggttacctgaacgacccagagtcgaccaagaacaccatcgacaaggacggctggctgcacaccggagacatcggcttggtggatgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgacatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaggttgccgcgccaagaagctaagggccgctcctcaggaacgcagtcacccatggtgctgttatagaccacaccaaatggggaaagaaactacgggagggtacatgatcagattattcttgcaggagatatcagtttgttggttcgccctgcttgtgtaatgttgataaaatgaaatgatataatagatgtgttgttttatttttttgaccatgtaagaacaaggctgggattttactcccaaacaaacaaaaagaacaaggctgggatttttttcaaaaaaaaaa

SEQ ID NO: 32 - DNA, 1798 bp, Lolium perenne
gctcaacactcgccaatcccacagccacagaagccacctaccaccgctccaccgatcgacgatggaggtcctcctcctggagaaggccctactggggctcttcgcggcggcggtgctggccatcgccgtcgcgaagctcgccggcaagcgcttccgcctcccgcccggcccctccggcgcccccatcgtcggcaactggctccaggtcggcgacgacctgaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtccccttcttcaccaacaaggtggtggcgcagaaccgggtgggctgggaggaggaggccaggctcgtggtggaggacgtcaaggccgacccggcgttcgcgaccgccggcaccgtgatccgccgtaggctgcagctcatgatgtacaacgacatgttccgcatcatgttcgaccgcaggttcgagtccgtcgacgacccgctcttcaacaagctcaaggccatgaacgccgagcgcagcatcctgtcgcagagcttcgactacaactacggcgacttcatccccattctccgaccgttcctccgcaagtacctcaaccggtgcacaaacctcacgaccaagaggatgaagctcttcgaggaccacttcgtcgctgacagaaagaaggcgctggagcagaatggggagatcaggtgcgccatggaccacatcctggaggcggagaggaagggcgagatcaaccacgacaacgtcctctacatcgtcgagaacatcaacgttgcagccatcgagacaacgctgtggtcgatcgagtggggcatcgcggagctggtgaaccacccggacgtccagtcgaagctccgcgacgagatgaccgccgtgctgggcgccgacgtggcggtgacggagccggacctggagcgcctcccctacctgcagtccgtcgtgaaggagaccctccgcctccgcatggccatcccgctgctcgtgccgcacatgaatctcagcgacgccaagctcgccggctacgacatccccgccgagtccaagatcctcgtcaacgcatggttcctcgccaacgaccccaagcggtgggtgcgcgccgacgagttcaggcccgagcgcttcctggaggaggagaaggccgtcgaggcccacggcaacgacttccgcttcgtgcccttcggcgtcggccgccggagctgccccgggatcgtcctcgcgctgcccatcatcggcatcacgctcggacgcctcgtgcagaacttccagctgctgccgccgcccgggcaggacaagatcgataccaccgagaagcccggacagttcagcaaccagatcctcaagcacgccaccgtcgtctgcaagccgctcgaggcctagaattttctatttgatcgtatggaggcttctgacatgcgtgtctgtgcatgcatgcgtgaacgctggtgccgggagatcgatctatgcacgcatgtgatgtgtattttcctttttttgtgcttttattttacttagttgcatttttgttggtcttcatgtaaggcgtcatgttgtagatttgctatgttggtgataatgatgtaaaacttcttcaaaaaaaaaaaaaaaaaa

SEQ ID NO: 33 - DNA, 1775 bp, Festuca arundinacea
gcaacaaccgttactgagcgcgcgaaaacgcacgagagagagagtgaagcggcgcgtgtattcttcactggccgtcgccatggatttcgtcttcgtggagaagctcctcgtcgggctcctagcgtccgtggtggtcgcgatcgtcgtgtccaagatccgcggccgcaaactgaggctgccgccgggccccatccccgtgcccatcttcggcaactggctgcaggtcggggacgacctgaaccaccgcaacctggcggcgatggcccgcaagttcggggaggtgttcctcctccgcatgggcatccgcaacctggtggtggtgtcgagcccggagctggccaaggaggtgctccacacgcagggcgtggagttcgggtcccgcacacgcaacgtcgtcttcgacatcttcaccggcaaggggcaggacatggtgttcacggtgtacggcgaccactggcgcaagatgcggcggatcatgacggtgcccttcttcacgaacaaggtggtgcagcagtaccgggccgggtgggaggcggaggcggccttcgttgtggacaacgtgcgcgccgaccccaaggccgccaccgacggcgtggtgctccgccgccacctgcagctgatgatgtacaacaacatgtaccgcatcatgttcgaccggcggttcgagagcatggacgacccgctcttcctccgcctcagggcgctcaacggcgagcgcagccgcctggcgcagagcttcgagtacaactacggcgacttcatccccgttctccgccccttcctccgcggctacctcgggctctgcgaacaggtcaaggagacccgcctcaagctcttcaaggattacttcctggacgagaggaagaagctggcgagcacaaagtccatggacaccaacggcctcaagtgcgccattgatcacatcctggaggcgcaggagaagggagagatcaacgaggacaacgtcctctacatcatcgagaacatcaacgtcgccgcgatcgagacgacgctgtggtcgatcgagtgggggatcgcggagctggtgaaccacccggagatccagcagaagctgcgcgacgagatggacgcggtgctgggcgccggccaccagatcacggagcccgacacgcacaagctcccctacctgcaagccgtgatcaaggagacgctgcggctgcgcatggctatcccgctgctggtgccgcacatgaaccttcacgacgccaagctcgccggctacaacatccccgccgagagcaagatcctcgtcaacgcctggttcctcgccaacaacccggagcagtggaagaggcccgacgagttccgccccgagcgcttcctggaggaggagaagcacgtcgaggccagcggcaacgacttcaggttcctgcccttcggcgtcggccgccggagctgcccggggatcatcctcgcgctgcccatcctcggcatcaccatcggccgcctcgtgcagaacttcgagctcaccacgccgccgggggtggacaagctcgacaccaccgagaagggtggccagttcagcctccacatcttgaaccactccaccatcgtcgccaagcccagagtgttctgagttctgagttgcgtgcagcttctggtttgatgctgtactctcttgcgtgcatgtttgctcgtcctaaaaccttaattatgtatgtctactacagagtagatacaagtttcgtatgttatctgcaagaaacagaggatatatatgaacttttttaaaaaacagtaaaaaaaaaaaaaaa

SEQ ID NO: 34 - DNA, 1323 bp, Lolium perenne
tcctctcgccgacgcgctcagagccaagagcatgggcatcgtcaacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgctccaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgcctcctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatgatcaacttggcaacgacgagcgaacctccattgagcgcgacaatttccgtgacatatactcctcaacttggttcaatacatgattgtgaactgtgtgaatgtgtttccgtcttctatcagagattcagagtgtgcatgttagtttcaataggaagaaatgtttggtatgagtccggcctaataataacggatttgctaaaaaaaaaa

SEQ ID NO: 35 - DNA, 1313 bp, Festuca arundinacea
ggtcccaagcccacccaatcctcaccagcatctctctcgcccacgcctccgatctcctctcgccgccgcgctcagtgccaagagaatgggcagcgtcgacgcctccgagaagacgatcaccgggtgggccgccagggacaccaccggtcacctctccccctacacgtacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccggaggtgagcaagtacagcgtcggcgacgtggttggcgtcggggtgatcgtcgggtgctgccacgactgccggccgtgcaaggccaacgttgagcagtactgcaacaagaagatctggtcgtacaacgacgtctacaccgacggcaagccaacgcagggcggcttcgcctccgccatggtcgtcgaccagaagttcgcggtgaagatcccggcggggctggcgccggagcaggcggcgccgctgctctgcgcgggggtgacggtgtacagcccactgaagcactttgggctgatgaccccaggcctccgcggcggcatcctgggcctcggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctcgactacatcatcgacaccgtgcccgtcaagcacccgctcgagccctacctcgcgctgctgaagatggacggcaagctcgtcctcatgggcgtgatcgccgagccgctcagcttcgtgtcccccatggtcatgctcgggaggaagaccatcacggggagcttcatcggcagcatcgaggagaccgaggaggtgctcaggttctgcgtcgaaaagggcctcacctcgcagatcgaggtcgtcaagatggactacctcaaccacgcccttgagaggctcgagcgcaacgacgtcaggtaccgcttcgtcgtcgacgtcgctgggagcaacatcaaggacgccgacgcctgatcgacttggaacctactccaagatagagcgcgataatttccgtgacatatgctcctcaactcggtgcagtacatgattgtgacctgtgtgtgaatttgtttccgtcttctatcagagtgcgtgctagtttccatggaaaaaa

SEQ ID NO: 36 - DNA, 1059 bp, Lolium perenne
gcaatcatccagcccagatctcacgcgtttccttcctccagctaaagaccggcaatggcgaccacggcggctgatgccacggccacggttgccaaggagcagaccaccaccaacggcgccgccagcggtgccgagcaggtcacccgccactccgaggtcgggcacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaggacggcacgatcttggccatggacatcaaccgcgagaactacgagaccatcggcaagccgtgcatcgagaaggccggcgtcgcgcacaagatcgacttccgcgaggggcccgcgctcccggtgctcgacgagctgctcgaggacgaggccaaccacggcaccttcgacttcgtcttcgtcgacgccgacaaggacaactacctcaactaccaccagcgcctcatgaagctcgtcagggtcggcggccttctcggctacgacaacacgctctggaacggatccgtcgtgctccccgccgacgcgcccatgcgcaagtacatccgctactaccgcgacttcgtcctcgagcttaacaaggccctcgccgcagacgaccgcgtcgagatctgccagctccccgtcggcgacggcatcaccctctgccgccgcgccaagtgattgtctgattgatgacgcgagcgcgccgccccctcggctccgctccgctccatggatgcggacaagaattgattaattattattccccattttgccgttctggctttcttctgtatcttcttggaaacaaatattgtccctttatgtacgtatatcaaatttatatccagacaaataatattactcctataaaaaaaaaaaaaaaaa

SEQ ID NO: 37 - DNA, 1063 bp, Festuca arundinacea
ggtcgactcagcaagacagcccaatcatccagcccagatctcgcgcgtttccttcctccagctaaagaccggcaatggcgaccacggcggctgatgccacggccacggtgcccaaggagcagcccgccaccaacggcgccgccagcggtgccgagcaggtcacccgccactccgaggtcggccacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgcaaagaagaccatggagatcggcgtctacaccggctactccctcctcgccaccgcgctcgccatcccagaagacggcacgatcttggccatggacatcaaccgcgagaactacgagaccatcggcaagccgtgcatcgagaaggccggcgtggcgcacaagatcgacttccgcgaggggcccgcgctcccggtcctggacgagctgctcgaggacgaggccaaccacggctccttcgacttcgtcttcgtcgacgccgacaaggacaactacctcaactaccaccagcgcctcatgaagctcgtcagggtcggcggcctcatcggctacgacaacacgctctggaacggatccgtagtgctccccgccgacgcgcccatgcgcaagtacatccgctactaccgcgacttcgtcctcgagctcaacaaggccctcgccgcagacgaccgcgtcgagatctgccagctccccgtcggcgacggcatcaccctctgccgccgcgccaagtgattgtctgattgatgacgctcgcgcgccgccccctctgctccgctccatggatgcggacaagaattaattaattattccccattttgcctttcttgctttcttctgtatcttcttggaaacaaatattgtccttttatgtacgtatacaaatttatatccagacaaataatattactcctataaaaaaaaaa

SEQ ID NO: 38 - DNA, 1333 bp, Lolium perenne
ggacgaatcctaccaaaccgagctaccagatccttctctactaatcgagctccctccgcctgtcctcgaccccgcctcaccgccggccggttctccgctccgagctatacgtccgtccgagaacacccgtcccatattaactatcaacatgacagtcgtcgaggtcttagctgccggcgacgccgccgccgccgcggtggcgcggcccgccgggaacgggcagaccgtgtgtgtgaccggcgccgccgggtacatcgcgtcctggctcgtcaagctgctgctggagaaggggtacactgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcatccccagtcactgacgaccccgagcaaatggtggagccggcggtgaggggcacgcagtacgtcatagacgcggcggcggaggccggcacggtgcggcggatggtgctcacctcctccatcggcgccgtcaccatgcaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgcaagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccacaaggtgctccgacgaggcgaacccgaggaagcagccatacaagatgtctaaccagaagctccaggacctcggactcgagttcaggccggtgagccagtccctgtacgagacggtgaagagcctccaggagaagggccaccttccggtgctcagcgagcaggcagaggcggacaaggaaaccctggctgcagagctgcaggcaggggttaccatccgagcatgaggaacaagaaatcaaccatgtccatactgctactgtcatgtaaaccaggcagtgtctgttgaatgcctaatctaagttcttgtaaaaaaaaaa

SEQ ID NO: 39 - DNA, 1237 bp, Festuca arundinacea
gcaagagctagttcttctgtccatccgtagctcttccctttcaccaacaagctagtttagacaagtacagtggtactgtaagagcaacaatgaccgttgtcgacgccgccgcgccgcagctgcctggccatgggcagaccgtgtgcgtcaccggcgccgcggggtacatcgcgtcggggctcgtcaagctgctcctggagagaggctacaccgtgaagggcacagtgaggaacccagatgatcccaagaacgcccacctgaaggcgctggacggcgccaccgagaggctgatcctctgcaaagccgacctcctcgactacgacgccatatgcgccgccgtcgagggctgccacggcgtgttccacaccgcctctccagtcaccgatgatcctgagcagatggtggagccggcggtgcggggcacggagtacgtgatcaacgcggcagcggatgcgggaacggtgcgccgggtggtgttcacgtcgtcaatcggtgccatcaccatggaccccaaccgcggtcctgacgtagtcgtcaatgagtcctgctggagcgacctcgaattctgcaagaaaaccaagaactggtactgctacggcaaggccgtggcggagcaggctgcgtgggaggcggccaggaagcgcggcatcgacctcgtcgtcgtgaaccctgtgctcgtggtagggccgctgctgcaaccaacggtgaacgctagcgccgcacacatcctcaagtacctcgacggctcggccaagaagtacgccaacgctgtgcagtcatacgtagacgtgcgtgacgtagccggcgcgcacatccgggtgttcgaggcgcctgaggcgtcgggccggtacctctgcgccgagcgcgtgctgcaccgtggggacgttgtccaaatcctcagcaaactcttccctgagtaccctgtgccaacaaggtgctctgatgaagtgaacccacggaagcagccttataagatgtccaaccaaaagctgcaggatcttggcctccagttcactcctgtgaacgactctctgtatgagaccgtaaagagcctccaggagaagggacatctcctagtaccaagcaaaccagagggattaaacggtgtaacggcatgatactgctaaaaaagcagcagagttcacgtgctcctgtaacatggtcaaacatgagttgtttttctgtataaattctatccagtatcgtgttatttaagtgaactaagagaaaaaaaaaa

SEQ ID NO: 40 - DNA, 1429 bp, Festuca arundinacea
gctctcgatcggcagacgcagagatcgatgggttccaccgccgccgacatggccgcgtccgccgaccaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcgccggacatggtggaccgcatgctccggctgctcgcgtcgtacaacgtcgtgacgtgcctggtagaggagggcaaggacgggcgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatccccttcaacaaggcgtacggcatgtcggcgttcgagtaccacggcacggacccgcgcttcaaccgcgttttcaacgaagggatgaagaaccactccatcatcatcaccaagaagctcctcgagctctaccacggcttccagggcctcggcaccctcgtcgacgtcggcggcggcgtcggcgccaccgtggccgccatcgccgcccactaccccgccatcaagggggtcaacttcgacctcccccacgtcatctccgaggcgccgcagttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaagcccagctcgcagggggtcttccacgtcgacatgatcatgctcgcgcacaaccccggcggcagggagaggtacgagagggagttcgaggccctggccaggggagctgggttcaccggcgtcaagtccacgtacatctacgcaaacgcgtgggccatcgagttcaccaagtagatgagatccctccggcctccatgcatccaggcaacctccccccgatatgagaacgatcgtcgtcgattttgctggctgctgcctttgctcctgcatcgatttgcaaacggaccctttggttggtttttcctctgttttccctaattttttcatgctctgaattttgaattttgatggctgggtcgtcgatctgctcggaaatgttttgaaaaggttgggtatgttggaaacttgtatgtgatgtaatgagatgatttttttcctttgttgaaaactcgagtaaattgaagtgactttcatcttcctttgaaaaaaaaaa

SEQ ID NO: 41 - DNA, 1457 bp, Lolium perenne
gctctcgctcacaccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggtctcggcagcctcgtcgacgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtccccccgatatgagaacgatcgtcgtcgatcttggtgggtgctgccgctgctcctgcatcgatcaccctttgcttggtttttcctctgttttccctaattttttcatgctttaaaaccattctgaattttaatggttgggtcgccgatctgctcggaatgtaccattaaaaacgatgttttgaaaaggttgggtatgttggaaacttgtatgtgatgtaatgaaatgatttttttccctttgttgaaaaaacgagtaaattgaagtgaaaaaaaaaa

SEQ ID NO: 42 - DNA, 1452 bp, Festuca arundinacea
gctcgctcacaccaaaatcacccaccagcaccagcatctctcgatcggcagaggcagagatcgatgggctccaccgccgccgacatgaccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcaccggacatggtggaccgcatgctccggctgctggcgtcgtacaacgttgtgtcgtgcctggtggaggagggcaaggacggccgcctctcccggaactacggcgccgcgcccgtgtgcaagttcctcacccccaacgaggacggcgtctccatggcggcgctcgcgctcatgaaccaggacaaggtcctcatggagagctggtactatctgaaggacgcggtccttgacggcggcatcccgttcaacaaggcgtacggcatgtcggcgttcgagtaccacggaacggacccgcgcttcaaccgcgtgttcaacgaagggatgaagaaccactccatcatcatcaccaagaagctcctcgagctctacgacggcttccagggactcggcaccctcgtcgacgttggcggcggcgtcggcgccaccgtggccgccatcaccgcccactaccccgccatcaagggggtcaacttcgacctcccccacgtcatctccgaggcgccgccgttcccgggcgtcacccacgtcggcggcgacatgttcaagaaggtgccctcgggcgacgccatcatgatgaagtggatcctccacgactggagcgaccagcactgcgcaacgctgctcaagaactgctacgacgcgctgccggcgcacggcaaggtggtgctggtggagtgcatcctgccggtgaacccggaggccaagcccagctcgcagggggtgttccacgtcgacatgatcatgctcgcgcacaaccccggcggcagggagaggtacgagagggagttcgaggccctcgccaggggagctgggttcgctggcgtcaagtccacatacatctacgccaacgcctgggccatcgagttcaccaagtagatgagatccctccatccaggcaacctcccaccgaaatgagaatcgtgggtattcgatcttgctggctgctgccgctgctcctgcatcgatctgcatacgtaccctttgcttggtttttcctctgttttccgtaattttctcatgctctgaatccattctgaattctaatggttgtgtcgtcgatctgctcggaatgtaccattaataatgctgttctgaaaaggttgcatatgttgtatatgatgtaatggcatgatttctctcctttgttgaatataccagtacattgaagtgtcaaaaaaaaaa

SEQ ID NO: 43 - DNA, 1440 bp, Lolium perenne
gctcgggtctctcgctcatactaccaaaaacacccagcagcacaccagcgtctctcggcccaggagaagcagacacaggcagagatgggctccaccgcagccgaaattgccgcgtccgccgacgaggaggcgtgcttgtacgccctccagctcggctcgtcgtcgatcctcccaatgacgctgaagaacaccatcgagcttggcctcctggagaccctcatggccgccggcgggaagtcgctgacccccaccgaggtggccgcaaagctcccgtgcgcagcgaagaacccggaagcaccagacatggtggaccgcatgctccggctgctggcgtcgtacaacttagtgtcgtgccttgtggaggagggtacggatggccgcctctcccggcggtacggcgccgcgccggtgtgcaagttcctcacccccaacgaggacggcgtctccatggcggcgctcgcgctcatgaaccaggacaaggtcctcatggagagctggtactacctgaaggacgcggtccttgacggcggcatcccgttcaacaaggcgtacggcatgtcggcgttcgagtaccacggcacagacctgcgcttcaaccgcgtgttcaacgaagcgatgaagaacaattccatcatcatcaccaagaagctcctccagctctacgacggcttccagggcctcggcaccctcgtcgatgtcggcggcggcgtcggcgccaccgtggccgccatcaccgcacactaccccaccatcaaggggatcaacttcgacctcccccacgtcatctccgaggcgccgccattcccgggcgtcacccacatcggcggcgacatgttcaagaaggtgccctcgggtgacgccatcctgatgaagtggatcctccacgactggagtgaccagcattgcgccacgctgctcaagaactgctacgacgcgctgccagtgcacggtaaggtggtgctggtggagtgcatcctgccggtgaacccggaggccaagcccagctcgcagggggtgttccacgtcgacatgatcatgctcgcgcacaacccaggcggcagggagaggtatgagagggagtacgaggcgctcgccaggggagctggcttcgccggcttcaagtccacatacatctacgccaacgcctgggccatcgagttcaccaagtagacgagaatcatgggtcttcgatcttgctggatgctgctgctgctccttcggtcaatctgcatgtgtaccctttgcttggtatttcctctgttttccataattttctcatgctctgaatctattccgaattctgatggctgtcgtcgatctgctcggaatgtaccattaataacgctgttcggtaaaggttgcatacagtatgttgtatgtgatgtaatgagatgatttatcccctttgttgaataaataaatttaagcttaaaaaaaaaa

SEQ ID NO: 44 - DNA, 2102 bp, Lolium perenne
gcatcaacctaaaacccacgctatccaacaccccctagagaaaaacaaaaacaaaaagattacagttcctggtttgagtatcaatcgatggtgggcttcgctaagatcgccatggagtggatccaagatccactgagctggctgttcatcgcctccgtggttttcgtggttctgcagcggcggcggcggggcaacgtggcgccgtttcccccgggcccgaaaccgctgccgatcgtcggcaacatgtcgatgatggaccagctcacccaccgtggcctggcggcgctagcgaaggagtacggcggccttctccacatccggctcggtaagctccacacctttgccgtgtcgacgccagagtatgcccgggaggtgctgcaggtgcaggacggtgccttctcgaaccgtcccgcgaccatcgccatcgcgtacctcacctacgaccgagccgacatggcgttcgcgcactacgggcccttctggcgccagatgcgcaagctgtgcgtgatgaagctcttcagccggcgccgcccggagacgtggctcgccgtgcgcgacgagtccgcggctctcgtccgcgccgtggccaggcggaccggcgagtccgtggacctcggcgagctcatttttaaactcaccaagaatgtcatcttccgcgccgcgttcggagctggtgcggtcgccgccgacgccgaggagggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcaacgccctcgacgagttcatcgacaagatcatcgacgagcacatggagaggggcaagaatcccgatgatgccgatgccgacatggtggacgacatgctcgcgttcctcccggaggcgaagccgaagaagggcgccgccggcgacggcgtggacgacctgcagaacacgctccgcctcacccgcgacaacatcaaggccattatcatggacgtgatgtttggcgggacggagacggtggcgtcggcgatcgagtgggcgatggcggagatgatgcacagccccgacgacctccgccgcctgcagcaggagctcgtcgacgtggtggggctcgaccggaacgtggacgagtcggacctcgacaagctccccttcctcaagtgcgtcatcaaggagacgctccggctgcacccgcccatcccgctgctcctccacgagaccgccgaggactgcgtcgtcggcggctactccgtgccccggggctcccgcgtcatgatcaacgtctacgccatcggccgcgaccgcagggcgtggaaggacgccgacgtgttccggccgtcgcggttcgtgcagggggaaggggaggccgccgggctcgacttcaaggggggatgcttcgagttcctgcccttcgggtcaggccgccgctcctgccctggcatggcgctcggcctgtacgcgctggagctcgccgtggcgcagctcgcgcacggtttcagctgggagctgcccgacgggatgaagccgtcggagctggacatgagcgacgtcttcggcctcaccgccccgcgcgccaccaggctcttcgccgtgcccacgccccgcctcgcatgcacccagctgctgggagctgacgacgccgggcgccaggcgtgacggccattgctgtgttagcaagcgatcgatggtatatgtaccagctggccggaagatgaaggtgtttgatatattcagaggtgatggcggaggcgccattggtggagcttggtggttttatcttgctttttttttactatttttcttaaactttgaactcaattaagtctggtgacaacagaacccaataagcggattatcatgcttgctggatgcatgcttggatacagtgttaagcatgatgtgttttaccatgaagaacgcaaattgtaaaaacaagtttttagacctgctgccccgagattctgtattttcttcctcttggttttccatcgtgaggactatattaatgccaggatgatagtacccgttgaaaaaaaaaa

SEQ ID NO: 45 - DNA, 2051 bp, Festuca arundinacea
gagagcatcaacctaaaacccacgcgatcgaacacccctagaaaaaaaaacaaaaacaaaaagattacagttcctggtttgagtatcaatcgatggtgggcttcgctaagatcgccatggagtggctccaagaaccactgagctggctgttcatcgcctccgtggttttcgtggttctgcagcggcggcggcggggcaacgtggcgccgtttcccccgggcccgaagccgctgccgatcgtcggcaacatgtcgatgatggaccagctgacccaccgtggcctggcggcgctcgcgaaggagtacggcggccttctccacatccggctcgggaagctccatgcctttgccgtgtcgacgccggaatatgcccgggaggtgctgcaggtgcaggacggcgccttctcgaaccgtcccgcgaccatcgccatcgcttacctcacctacgaccgagccgacatggcgttcgcgcactacgggcccttctggcgccagatgcgcaagctgtgcgtgatgaagctcttcagccggcgccggccggagacgtggctcgccgtgcgcgacgagtccgcggcgctcgtccgcgccgtggccaggcggagcggcgagtccgtggacctcggcgagctcatttttaaactcaccaagaatgtcatcttccgcgccgcgttcggcgctggtgcggtcgccggcgacggcgacggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcgccgccctcgacgagttcatcgacaagatcatcgacgagcacatggagaggggcaagaatcccgacgacgccgacgccgacatggtggacgacatgctcgcgttcctcccggagacgaagccgaagaagggcgccgccggcgacggcgtggacgacctgcagaacacgctccgcctcacccgtgacaacatcaaggccatcatcatggacgtgatgtttggcgggacggagacggtggcgtcggcgatcgagtgggcgatggcggagatgatgcacagccccggcgacctccgccgcctgcagcaggagctcgccgacgtcgtggggctcgaccggaacgtggacgagtcggacctcgacaagctccccttcctcaagtgcgtcatcaaggagacgctccggctgcacccgcccatcccgctgctcctccacgagaccgccgaggactgcatcgtcggcggctactccgtgccccggggttcccgcgtcatgatcaacgtctacgccatcggccgcgaccgcaaggcgtggaaggacgccgacgtgttccggccgtcgcggttcgtgcagggggaaggggaggccgccgggctcgacttcaaggggggatgcttcgagttcttgccctttgggtccggccgccgctcctgccctggcatggcgctcggcctgtacgcactggagctcgccgtggcgcagctcgcgcacgggttcagctgggagctgcccgacgggatgaagccgtcggagctggacatgagcgacgtcttcggcctcaccgcgccgcgcgccaccaggctcttcgccgtgcccacgccccgcctcgcatgcacccagctgctgggggctgacgacgccgggcgtcaggcgtgacgtcgtcgtgcgcgcgcgcggccattgttgtgttagcaagcgatcgatggtatatgtaccagctggaagatgaaggtgtttgatatattcagaggtgatggcggcggcgccattggtggagcttggtggttttctcttgctttttttacaactgttgttttactttgaactcaattaagtctggtcacaacagaacacaataagcggattatcatgctcgctggatgcatgcttaggatacagttaagcatggcgtgttctaccatcaagaccgcaaattgtataaaaagtttttagacctgctgcaccgcaaattgtataaaaaaaaaa

SEQ ID NO: 46 - DNA, 2461 bp, Lolium perenne
ggttctttgcaacgatcaacactgtcagaatccagatacacacacacacacacacacaccaagcagcgtctagctagcttacttgctctagtagttctttgcaaatatccatggagtccgagaacgttgccgccaacggcgatggcctgtgcgtggcacagccggctcgcgccgaccctctgaactggggaaaagcagccgaggagctgtctgggagccatcttgatgccgtgaagcgaatggtggaggagtaccgccgccctgtggtgaccatggaaggcgccagcctgactatcgccatggtcgctgcggtggctgccggcgccgacaccagggtggagctcgacgagtccgcccgcggacgcgtcaaggagagcagcgactgggtcatgaacagcatggccaacggcaccgacagctacggtgtcaccaccggcttcggtgccacctcccaccggaggaccaaggagggtggcgctctccagagagagctcatcaggtttctcaatgcgggagcattcggcaccggcagcgatggccacgttctgcccgctgcgacgacgagggctgccatgcttgtccgtgtcaacaccctgctccagggctactctggtatccgctttgagatcctcgagacggtcgccacgcttctcaacgccaacgtgacaccgtgcctaccgctccggggcacgatcacggcatccggtgacctcgttccgctgtcctacatcgcgggccttgtgaccggccgcccaaattctgtggcgactgctccggatggcacgaaggttaacgctgcagaggcattcaaaatcgcgggcatccagcacggtttctttgagctgcagcctaaggaaggccttgccatggtcaacggcaccgcggtgggctccggactggcgtccatggtgctcttcgaggctaacatccttggcatcctcgctgaggttctgtcggctgtgttctgtgaggtcatgaacggcaagccagagtacaccgaccacctcacgcacaagttgaagcaccaccctggtcagattgaggccgcggctatcatggagcacatccttgaaggaagctcctacatgatgctcgcgaagaagctcggcgagctcgacccactgatgaagccgaagcaagataggtatgcccttcgaacatcaccgcaatggctgggccctcagattgaggttatccgtgccgccaccaagtccatcgagcgcgagatcaactccgtcaacgacaacccgctcatcgacgtctctcgaggcaaggccatccatggtggcaacttccagggcacacccatcggtgtgtccatggataacaccaggcttgccattgctgcgatcggcaagctcatgtttgcccagttctctgagctagtgaacgacttctacaacaatggtttgccttccaatctctcgggtgggcgcaacccgagcttggactatggcttcaagggtgctgagattgccatggcctcctattgctccgagctccaattcttgggcaaccctgtgactaaccatgtgcagagtgcggagcagcacaaccaagacgtcaactctcttggtctcatctctgctaggaagacctctgaggccatcgatattctgaagctcatgtcatcgacattcttggttgcactgtgccaagctatcgacctccgccacctcgaggagaatgtcaagaatgccgtcaagaactgtgtgaagatggtggctaggaagaccctgagcaccaatgacagtggccatctccacagcgcacgcttctgcgagaaggacctgctcttgacgatcgaccgcgaggcggtgttcgcctacgcagacgacccttgcagcgctaactacccactgatgcagaagatgcgtgcagttctcgtggagcacgccttggccaacggtgaggctgagcgggatgtgcagacgtcagtgttcgccaagcttgccgcattcgagcaggagctccgtgcagtgcttccaagggaggtcgagtcagcccggtgtgctgtggagaatggcaccgccgcgcagcaaaaccgcatcaccgaatgccggtcgtacccgctgtaccgcttcgtgcgcaaggagctcggaaccgagtacttgaccggagagaagacgaggtctcctggtgaagaggtggacaaggtgtttgtggctatgaaccaggggaaacacatcgacgcactgcttgagtgcctcaaggagtggaacggtgagcccctgcctatctgctgaagaatgaatcaaggaactgaagaatagagtacttgagagttcagaaggctccacatgtgcttagttaatagtaagtatagtactgttttttcattgtatcttgtgcattatatatacatgtaacactggaataaaatttcaaaaaatcagatcactcaatgggcagcatgtaacactggaataaaaatttcaaaaaaatcagatcaaaaaaaaaa

SEQ ID NO: 47 - DNA, 2596 bp, Festuca arundinacea
gctcctctgtaattcgagctcctcttcagcacaagtacttccaccagagtgccagacaacaatccagcaccacttccagaatacatacacacacgtacccgtgtctaaaccttacttgctttcctagttctttgcatatctccatggagtgcgagaacgggcacgttgccgccaacggcgatggcctctgcgtggcgcagccagcccgggccgaccctctcaactgggggaaggcagcagaggagctgtccgggagccatttggatgccgtgaagcggatggtcgaagagtaccgcagaccagtcgtgaccatggagggcgccagcttgaccattgctatggtcgccgcggtggccgccggcgccgacacccgggtggagctcgacgagtccgcccgcggacgcgtcaaggagagcagcgactgggtcatgaacagcatggcgaacggtaccgacagctatggtgtcaccaccggcttcggcgccacctcacaccggaggaccaaggagggtggcgctctgcagagagagctcatcaggttccttaacgcgggagcatttggcaccggcagcgatggccatgttttgcccgctgcaacaaccagggcggccatgctcgtccgtgtcaacactctgctccaggggtactctggcatccgcttcgaaattctcgagacgatcgccacgcttctcaatgccaacgtgacgccgtgcctaccgtaccggggcacaatcacggcatccggcgacctcgtcccattatcctacatcgccggccttgtgactggccgcccaaactctgtggcgacagctccagatggcagcaaggttaacgcagcagaggctttcaagattgccggcatccagcatggcttctttgagctgcagcccaaggaaggccttgccatggtcaacggcactgccgtgggctccgggctcgcgtccatagtgcttttcgaagctaacatccttggcatccttgccgaggttctatcggccgtgttctgcgaggtgatgaatggcaagccggagtacaccgaccacctaacacacaagctgaagcaccacccgggccagatcgaggccgcggccatcatggagcacatccttgaaggcagctcctacatgatgctcgcgaagaagctcggtgagctcgacccactgatgaagccaaaacaagataggtatgcactccgcacatcaccacaatggctcggccctcagatcgaggtcatccgtgctgctaccaagtccatcgagcgtgagatcaactccgtcaacgacaacccactcatcgacgtctcccgcggcaaggctatccacggtggcaacttccagggcacgcccatcggtgtgtccatggacaacaccaggcttgccattgcggccatcggcaagctcatgtttgcccagttctcggagcttgtgaacgatttctacaacaacggtttgccttccaatctctctggtgggcgcaatccgagcttggactatggcttcaagggtgctgagattgctatggcctcatactgctccgagctccagttcttgggcaaccctgtgactaaccatgtgcagagcgccgagcagcacaatcaagacgtcaactctctcggcctcatctcttccaggaagaccgctgaggcgattgacattttgaagctcatgtcctcgacattcatggttgccttgtgccaagctatcgacctccgccacatcgaggagaatgtcaagaatgccgtcaagaactgtgtgaagacggtggctaggaagaccctgagcaccaatgacagtgggcatctccacaatgcacgcttctgcgagaaggacctgctcctgacgatcgaccgtgaggcggtgttcgcctacgcagatgacccttgcagcgccaactacccgctgatgcagaagatgcgtgcggttctcgtggagcatgccttggccaacggtgaagccgagcaggacgtgcagacgtcagtgttcgccaagcttgccacattcgagcaagagctccgtgcggttcttcccaaggaggtcgagtctgcccggtgttccgtggagaacggcaccgccgcacagcagaaccgcatcagcgaatgccggtcatacccgctctatcgcttcgtgcgcaaggagctcgggactgagtatttgaccggagagaagacgaggtctcctggtgaagaggtggacaaggtgtttgttgctatgaaccagggtaagcacattgacgcgctgcttgagtgcctcaaggagtggaacggtgagcccctgcctatctgctgaagaatggctcaaggaactcaagaatagagtgcttgagaattcagatggtactgttttataattatatctccggatatcgatgtttgcaatgttcctccagagctgcaatgccagttagaaaagataatagcatgacttggtagtgttgtttagcctagaaattttctatgatgttagttagtaaaagggtacactttgtgataaatatacataattattgcactagtcctttatttttatatcaatgttctgtctactgaggcaactttgaaggattcaaagaatctagtattggcctgccaaaaaaaaaa

SEQ ID NO: 48 - DNA, 1301 bp, Festuca arundinacea
ggtcccttgtatcagctgatcatggctttttccggcagcgtcagcggcgttgttctcgtcgtggcgatcctgcttctgggtctggccgcggcggcgtcggcacagctgtcggcgacgttctacgacgcgtcctgcccgagcgcgctcgcgacgatcaagagcgccgtgacggcggcggtgaacaacgaggcccgcatgggagcctccctgctcaggctccacttccacgactgtttcgtccaaggatgcgacgcgtcggtgctcctcaacgacaccgccaacttcaccggcgagcagacggccttccccaaccgcaactccatcaggggactcaacgtcatcgacaacgtcaaggcgcaggtcgaggccgtatgcacgcagaccgtctcctgcgccgacatcctcgccgtcgccgcccgcgactccatcgtcgccctaggagggccgtcgtacacggttccgctggggaggagggactccaccaccgcgagcctgtccgaggcgaacagggacctcccgccgccgtcctccgacctcgccgatctcgtcggcaacttctccaggaaaggcctcagcgtcaccgacatggttgcgctctcaggagcccacacgatcgggcgggcggcatgcttaaacttccggagccggatctacggcgagtccaacatcgccccggcgtacgcggcgtcgctgcaggccaactgcccgcagtccgcccccaatggcgacggtacactcgcaccgctcgacgtgtccacccccgacgccttcgacaacgcctactacggcaacctgctctcgcagcaggggctcctccactcggaccagcagctcttcaacggcggctcgaccgactccctcgtcagcacctacgcctccaacgccgcgcagttcagcggcgacttcgccgcggccatggtgaacatgggcaacatcggcgtgctcaccggcgcccagggggagatccggctcaattgtggcaaggtgaattgagtgaaagcccgacaactgagactgcaggtgaaagtggatggggcacatgcaattgcgaagctgggctggtagctttactgaaaccgaataaggtgtcaacgtgaaggccatattgatgtgcttattgggcctatcttggaattccttacagggattcagattcagtcatttctccttcgcatggtctatttgtttcccacagaaaataaggatataataatactgtataatcctgtaaaaaaaggaaacgatactgtatagttgtgcctatcaacaaccacatttctggttgaaagctaaaaaaaaaa

SEQ ID NO: 49 - DNA, 1236 bp, Lolium perenne
gagatggcttcttcttcctcccccttttctcgggtctcccagctagccgtcaaggcgacggtcctggcggccgtctgcctcctcctccacggcggaggcgggagtagcgcatcggcggcggagctgtgcgtgagctactacgaccacacgtgtccggacgcgtacaagatcgtgcagggggtgctggtggaggctcacaagtcggacccgcgcatcttcgccagcctcatccgcctccatttccacgactgcttcgtgctgggctgcgacggctcgctgctgctggacaccttccccggcttccagtccgagaaggacgcgcgccccaacaacaactcggcgcgcggctaccccgtcgtcgacgccgccaaggccgctctcgagaaggcgtgccccggagtcgtctcctgcgccgacatcctcgccctcgccgccgagatctccgtccagctgtccggaggacccgggtggggcgtgttgctggggaggctggacggtaagacctccagcatagccggcgcccagaacctacccggcccgttcgacggcctcaagaatctcacccttaagttccaagccgtcaatctcgacgttactgacctcgtcgctctctcaggtgctcacactttcggtcgcgtgaaatgccggttcgtcacgaaccgtctgtacaacttcagcgggacgaaccagcctgacccgaccctaaatgcggcttaccgggcgttcctgtcaacgagatgcccaaggaacggcgatgcaaactctctaaatgaccttgatccgacgacgcccgacacctttgacaagaactacttcacgaacctcgagaaaaatcgcggctttcttgactctgaccaacaactcaaatcagacccaggtgcattaacgacgacggcgccgattgtcgataggtttgcaagcagccaggacgcattctttaagagcttcgcatggtctatgatcaagatgggaaacattctgccaattacagatccctcccgtggagaagtccggaaacactgcgcgtttgtcaattgatgttaattagcaagaaggccacatgtggatacaactacggcctatgctatatgcgcaaaatcatggatctcattgtcatgttcaataattggtaatatatatgccaaccaatgtacgtaagattatgtgcatgctttgatcccacaagtgcaatgaagtgaaatcttatttcccgtttgaggttgatcaaaaaaaaaa

SEQ ID NO: 50 - DNA, 1205 bp, Festuca arundinacea
gcaagcttccctcgattagctaccttgtctagccaccgtcgtccttgcacagccaaggaagaagcaaagctatttggcttctaacaatggcgacgaggggtgtcatggtggcgctgctgctcgcggcggtggcggcgtcttgcgctcatgcacagctgcacgagaagttctacagtgagtcgtgccccagcgtggaggacgtcgtccggaaggagatggtcatggcgctatccctcgcgccaagcctcgccgcgccgctcctcaggatgcacttccacgactgcttcgtcagggggtgcgacggctcggttctgctggactcggcgaacaagacggcggagaaggacgcgctgcccaaccagacgctgcgcggcttcgacttcgtcgagagggtgaaggccgccgtggagaaggcctgccccgacaccgtctcctgcgccgacgtggtcacgctcatagccagggacgctgtctggctgagcaaaggcccattctgggaagttcctttgggccggcgagacggcagcgtgtccatctccaacgagaccgacgcgctgccccctcccaccgccaacatcaccgtgctcacccagctcttcgccgccaagaaccttgacatcaaggacctcgtcgtcctctctgccgcgcacacgatcgggacatcgcactgcttctccttctccgaccggctctacaacttcacgggcctcgacaacgccagcgacatcgaccccacccttgaacctttctacatggcaaagctgaagagcaagtgcaccagtctcgacgacaacagcacgctcgtggaaatggaccccgggagcttcaagaccttcgacctcgactacttcaagctcgtcagcaagcggaggggcctcttccactccgacggtgccctcctcaccgacgccttcacccgtgcctacatcctgcgccacgccaccggcgccttcaaggacgagttcttcgccgactttgccgtctccatggtaaagatgggcaacaccgacgtgctcactggaagccagggcgagatcaggaagaagtgctccgtggtgaaccattagttagccgtggaagtaccggttggcataccaacccttttgatttgtgaccatgttttttttctgtgtagattattactgtaaaaccgttacttcattttcctctccccaagttcttttcttcgttggttaaaaaaaaaa

SEQ ID NO: 51 - DNA, 1382 bp, Lolium perenne
ggccacaactcgccacatttggcatagcgagcactgacagcgagctacatccatcaccatggcttctagccgtgtcctgctcctcgtcgtggcagctctggcgatctccgtgtccgccacggccgcggccaccaagatcagtgctccactaccgccgctggccaagggcctgaacttcgatttctacaaggccacctgcccgcaggccgagtccatcgtcttcaacttcctccgcgacgccatccgcaaggacgtcggcctcgccgccgcgctcctccgcatccacttccacgactgcttcgtgcagggctgcgacggctccgtgctcctcgacaagaccggcggcaccgacagcgagaagatcgcaccacccaacgtcacgctccgccccaccgccttcaaggccatcaacgacctccgcgctctcctcgccaaggcctgcggcgccgtcgtctcctgcgccgacatcgccgccctggccgcgcgcgactccgtgcacctcgccggcgggccgcactaccccgtcccgctcggccgccgcgacgggctcgcccccgcgaacctcaccaccatcctcaacgccctcccggcaccgagctccaacgtcaccaccctcctcagattcctcgccaagatcagcctcgacgccaacgacctcgtcgcgctatccggcgcgcacacgctcggcatcgcgcactgcacctccttccaggagcgcctcttcccgcagaacgacgtcaccctcaacaagtggttcgcgtcgcagctcaggctcacctgcccggcgctcaacaccgacaacaccaccaacaacgacatccgcacccccaacgtcttcgacaacaagtactacgtcgacctgctcaaccgccagggactcttcacctccgaccaggacctgcacaccgacgccaggaccaagcccaccgtcaccaggttcgccgtcgaccaggccgcctttttcgaccagttcgtcttctccgtcgtcaagatgggccagatcaacgtgctcaccggcagccagggacagatacgcaacgactgctccgcgcccaacaaaggccgcaccaacgacgacctgccgtggtccgtgctcgagaccgtcaccgaggccgcccagagcttggtgttgtagatatgcgctgtggataggttggttcagtcgatccatctctagcctacgtactttcttcccaaagttgtagctttattagcgagccgtgtggtaatggtttgggctttgagagccacagttgatgcatgtgtgtttagtttcttgagcaactcgaccagtttaataatcacgagatggtttttggtgtgtcgaatgacgactagaaaattgagatgaatatttgatgttattttcaataaaaaaaaaa

SEQ ID NO: 52 - DNA, 1261 bp, Lolium perenne
gatcgcctttctcctccatgaccaccatgggcggctcgtcgatcctgcccgcgccgaccgtggcgacgacggcgctggttctgctgatcgtgctgttcgcatcgccggcaacggtggcgaaaggttctgggctgtccgtcgggttctacaagaagttgtgtccgaaggcggagaaggtcgtccggcgaactgtcaccaaggcctttgagaaggagcctggcaccccggccgacatcatccgcctcttctttcacgactgctttgtccgagggtgcgacgcatcggtgctgctggaatccacgccagggcgcatggcggagagggactcgaaggcaaacaaccccagcttggatgggtttgaggtcattagcgacgccaaggagacccttgagaagctctgcccgcaaaccgtctcctgtgctgacattctcgccctcgccgcccgcgatggcgcctacctcgctagcgggctcgactatgcggtgcccaccggccgccgtgatggcctcgtctccaaggaagacgaggttctccctagtgtccctcaccccgacttcaaccattctcagctcgtggaaaacttcacggcaaaaggctttacggcggaggagatggtgacgctgtcgggggcgcacaccatcggcacctcgcactgctcgtccttcacggaccgcctctacaacttctcccagggcggcgcgctgaccacggaccctgcgctgccggcggcatacgccgcgctgctgaaggagaagtgcccgccggagacagcggcgcagaacgacaccaccatggtgcagctcgacgacgtgacgccgttcgtgatggacaaccagtactacaagaacctgcttgccggcaccgtgccgctcggctccgacgtagcgctcatggagagccccgacacggcggcgctcgtcgagctctacgcccgcgagcccgccgagtactgggccaagcgcttcgttgcggcgatggtcaaggtgagcgagatggaggtgctcaccggggccgagggggagatccggctcaactgctccaaggtgaactagtatataaccggttgctgcgtttgtctctgtactatatgtttgggaaagatgacgatacacgttcttcttttgtgttaatgttttttctttcatttgttttcatatggtggtgagaaatatatacacatttgtttgcgtcataaactgtaaagcttacacagcatgcataaaagcatctatatcattccatttgagttgtaaaaaaaaaa

SEQ ID NO: 53 - DNA, 1059 bp, Lolium perenne
acgagggagaactactacgggtcttcttgtcccaccgcgcttctcaccatcaggactgtcgtgacgacggcggtgctgctggaccaccgcatgggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaa

SEQ ID NO: 54 - DNA, 1266 bp, Festuca arundinacea
ggccagataacaagtgcaggcagcaaaccagttacaggcacgccgcaatatagcttgggtcttgtagctagccatagccatggcatctgcctcttgcatttctttggtgttgctggtggctctggccgccacggcggcgtcggcgcagctgtcgtcaacgttctatgacacgtcgtgccccagggccctggccaccatcaagagcggcgtggcggccgccgtgagcagcaacccccgcatgggtgcgtcgctgctcaggctgcacttccacgactgctttgttaatggctgtgacgcgtccgttctgctgtcgggcaacgagcagaacgcgcccgcgaacgccggttcgctgtttggcttcggcgtcatcgacaacatcaagacccagctcgagggtatctgcaagcagaccgtctcctgcgccgacatcctcaccgtcgccgcccgtgactctgtcgtcgccctcggaggcccgtcatggacagttcctctcggcagacgggactcgacgagcgcaaccggcaataccggggacctcccgggccctggatccagcctcgcacagctccaggccgcgttcgccaagaagaacctgaacaccgtggacatggtagcgctctccggcgcgcacaccatcgggcgggcgcagtgccagaacttccggtcgcggatctacggcggcgactctaacatcaacgccgccttcgcgacctcgctcaaggccaactgcccgcagtccggcggcaacggcaacctggcggcgctggacgccacgaccgccaacgccttcgacaacgcctactacaccaacctgctctcccagaaggggctcctccactccgaccaggtgctcttcaacaacggcagcaccgacaacaccgtcaggaacttcgcgtccagcggggcggcgttcagcagcgccttcgcgacggcgatgatcaagatgggcaacatctcgccgctgacagggacgcaggggcagatcaggctcagctgctccaaggtgaactcgtgattagcgtacgaggagccgacagacagtcgccagcactatacgtcacgtgaatgaataaggccacagaaccggcggccaatccacagtactattagcagttcagcactagctagaaccgtgtatatatatacgtgcagctcaaaattattcatgcacctctacacatgtaactatcgaattctctcatgcaaaggcataaagaattacttcaatatatacaactacaactaccattattctcaaaaaaaaaa

SEQ ID NO: 55 - DNA, 1164 bp, Lolium perenne
gctagctccccggcgctaccttcgccttccgctccccctctccggccttgcgccctctgccgccaagtcgcctggcttggccggtcggcactcccctcatcccctggctcacccctcccctcaggctcctcttcctctcccctggccctggaggcagtcggtcggatctggccggtcgccggagacgcgctcggccgtccactgctcgccgccgctgccttctagccactaccgttcagcctccagagccaagcggcagtctagcccaacagcaggagcgtagaatagtgttacctcttgtttcattattcaatatacaaaatggccgtgtcggagcttgaggtcgacggcgtcgtcttcccgccgctggcccgtccgccgggcacagcccacgcgcacttcctcgccggcgcaggtgtgcgagggatggagctcggcggcaacttcatcaagttcacggccatcggcgtgtacctgcaggccgacgccgccgtgtccgcgctcgccacgaagtgggccgggaaacccgccgacgagcttgctgcagacaacgccttcttccgcgacgtcgtcacaggcgagttcgagaagttcacgccggtgaccatgatcctgccgctcaccggcgcgcagtactccgagaaggtgaccgagaactgcgtcgcgtactggaaggccgtcggcaagtacacgaacgccgaggccgccgccgtcgacaagttcaaggaggccttcaggactgagagcttccctcccggcgcgtccatcctcttcacccactcccccgccggcgtcctcaccgtcgcgttctcgaaggactcgtcggtaccagagtcgggcggcgtggcgatcgagaacaggccgctctgcgaggccgtgctggagtccatcatcggcgagcacggggtctcgccggcggcgaagctcagcctggcgaccagggtcgccgagctcctgaatgaggccgcccccgtcggccaagcggcggcagagcccgtgtcggtttctgcgtgaacggaccggacaccgtcactgctggcttgtgtggttggcgatgtccgttgttgagacgtcgtgttccggagtttctaccgttgttttctgttgtgtcgaggtgaaccgtgctaacttgaataaagaaaccgctgcccaagaaaaaaaaaa

SEQ ID NO: 56 - DNA, 933 bp, Festuca arundinacea
gtgcacacacagctacccatccaatccacccctgtctccggccgcgcgcgcatcgatctcataccatcggccgtctcggagcttgaggtcgacggcgtcgtcttcccgccgctggcccgtccgccgggcacagcccacgcgcacttcctcgccggcgcaggtgtgcgagggatggagctcggcggcaacttcatcaagttcacggccatcggcgtgtacctgcaggccgacgccgccgtgtccgcgctcgccgcgaagtgggccgggaaacccgccgacgagcttgccgcagacaacgccttcttccgcgacgtcgtcacgggcgagttcgagaagttcaggcgggtgaccatgatcctgccgctcaccggcgcgcagtactccgagaaggtgaccgagaactgcgtcgcctactggaaggccgtcggcaagtacacggacgctgaggccgccgccgtcgacaagttcaaggaggccttcaaggccgagagtttccctcccggcgcgtccatcctctttacccactcccccgccggcgtcctcaccgtcgcgttctcgaaagactcgtcgttgccggagtcgggcggcgtggcgatagagaacaggccgctctgcgaggccgtgctgaagtccatcatcggcaagcatggggtctcgccggccgcgaagctcagcctggcgaccagggtcgccgagctcctgaaggaggccgcacccgtcggcgagccggcggtggcagagcccgtgtcggtttcagcatgaacggactgggcaccgtcactgctggcttatacatgtggttggtgatgtccgtgttgagacatcgtgttccggagcttctaccgttgtttctcttgcgtccaggtcaaccgtgctaacttgaataaagaaaccccagccattgaaatttatttacatcaaataaaaaaaaaa

SEQ ID NO: 57 - DNA, 1531 bp, Lolium perenne
gactcattcatctgtcgtctcctgcttccctcaagcttagatcgattgcagccggccggggactgtcgagctaccactgccggtcgctggtacgagcggacgtaaggagagatccagatggccgcgacgatgaccgtggaggaggtgaggaaggcacagcgggcggaggggccggcgacggtgctggccatcggcacggcgacgcccgctaactgtgtctaccaggctgactacccggactactacttcaagatcaccaagagcgaccacctcgccgatctcaaggagaagttcaagaggatgtgcgacaagtctcagatcaggaagaggtacatgcacctgacggaggagatcctggaggagaaccccaacatgtgcgcgtacatggcgccgtcgctggacgcgcgccaggacatagttgtcgtcgaggtcccgaagctcgggaaggcggcggcacagaaggcgatcaaggagtggggccagccgcggtccaagatcacccacctcgtcttctgcactacctctggtgtggacatgccaggcgccgactaccagctcaccaagatgctcggcctgcgcccgtcggtgaagcgcctcatgatgtaccagcagggctgcttcgccggcggcacggtgctccgcctcgccaaggacctggctgaaaacaaccgcggcgcgcgcgtgctggtggtctgctcggagatcacggccgtgaccttccgcggcccgcacgagtcacacctcgactcgctggtcggccaggcgctcttcggggacggcgctgccgcggtgataatcggcgccgaccccgacgtgtccgtcgagcgcccgctgttccagctggtgtcggcgagccagaccatcctgccggactcggagggcgccatcgacggccacctcagggaggtcggcctcaccttccacctcctcaaggacgtgcccgggctcatctccaagaacatcgagcgcgccctggaggaagccttcaagccgctcggcatcgacgactggaactccgtcttttgggtggcgcacccgggcgggccggcgatcctcgacatggtggaggcaaaggtaaacctcaacaaggagcggatgcgtgccaccaggcacgtcctctccgagtacggcaacatgtccagcgcatgcgtcctcttcatcatggacgagatgcgcaagcgctctgccgaggatggtcacaccaccaccggcgagggaatggattggggcgtcctctttggcttcgggcccggcctcaccgtcgagaccgttgtcctccacagcatgcccattgccgctgatgccaccgcttgatcgatggttccatctccgtttatctgccacatcgatggatacctactactactaccgccgccgccgctgctatccaaagtaatttgtattgtattcatgcatacctggtttgtatttgttggtaggattcgttccgctattatgtcgcttgtgtcgcgtacactgttgtatcctagtaatagtaatcaaacggagtacggtttatgtaaaaaaaaaa

SEQ ID NO: 58 - DNA, 774 bp, Festuca arundinacea
acagatgtacttcgtgtccaagtccctggcggagaacgccgccatggactacgccaaagagaacggcgtggacttcatcagcatcatccccacgctcgtcgtcggccccttcctcagcgccggcatgccgcccagcctggtcaccgccctggcactcatcacggggaacgaggcccactactcgatcctgaagcaggtgcagctggtccacctggacgacctctgcgactccatgacctacctcttcgagcacccggacgccaacggccgctacatctgctcctcccacgacaccaccattcatggcatcgccaggatgctcaaggagaggttccccgagtacgacatcccacagaaattcccgggagccgacgacgaccttcagccgatccacttcttcttcaagaagctgctcgaccacgggttcaggttcaggtacaccgccgaggacatgttcgacgccgcggtctggacgtgcagggagaagggcctgattccgctcggagcggaaggggcaggcggcccggccagtgcagccggcaagctgggagctgttctcgtgggcgaaggtcaggcgattggtgctgagacataagcgctagtgcatgtacactaggctggctacctcagacacatggtggagcgatgattatgttcgttaattctactatcctatatttcggttcagaaattgcattaagagaaccctgtaattggtgggatattatgaacggattatggaacgcaaataacttcatgacggaaaaaaaaaaa

SEQ ID NO: 59 - DNA, 1211 bp, Lolium perenne
gggagcaccacacatggcgactgaagccaagggggagacggtgctggtcaccggcgccagcggcttcatcggctcctggctcgtccgcctcctcctcgcccgcggctactccgtccacgccgccgtcctcaaccccgatgacaaggccgagacggaccacctcctcgcgctcgccgctgcggccggcgacgagggccgcatccgcttcttcaggtgcgacctcctcgacggcgccgccatgctcgccgccgtgcggggatgctccggcgtgttccacctcgcctctccctgcaccgtcaacctcgtcctcaacccccaaaaggagcttgtggtgccggcggtggagggcacgctcaacgtgctgcgcgccgccaaggaagctgggggagtgcggcgggtggtggtgacctcctccgtctccgccctcgtcccctgcccggggtggccggccggcgaggtcctcgacgagcgctgctggaccgacatcgactactgcgacaagaacggggtttggtaccctgcttcaaaggcactggcggagaaggcggcatggaagtttgcagaggagaatggactggatgtggtgacggtcaatccagggacggttttgggcgagatgattccgccaaggctcaatgccagcatggccatgtttcttcgcttacttgaaggttgcaaagaggagtatgcagatttcttcatcgggccagtgcacgtggaagacgttgcattagcccatattctgctgtacgagaatccgtcagcatccgggaggcacctctgcgtggagcccatctgtcactggagtgttttcgcggcgaaagtcgccgagctctaccctgattacaaagttccaaaattccctgaggacacacagcctgggctggtgagggcgaaggcggtgccaaaaaagctgatggcgttgggtttgcagttcactcctcttgagaagatcatcagggatgccgtggagagcctcaagagcagaggatgcatcgcctgatgattggatcgttaggcatgtcacccttccgtcgtaggttcatgatcatccttgttgaaaaatgtgttgtgttgtgtccagcccagtgcctacccagaccatatacttaccagtatgatttgtgcaataacagccggttgatgtacggcatcacctgccctacacttgggatgcggatgctgtcacactgactccctcaaaaaaaaaa

SEQ ID NO: 60 - DNA, 1229 bp, Lolium perenne
ggctcaaccaagggcaaagtgtgtgtaactggggcttcaggctttgttgcctcttggctcatcaagaaactccttgagtctggatatcatgtgatagggactgtcagagacccagggaatcgaagaaaggtgggacacctttggaaactaccaggtgcaaatgagaggctccaacttgtgagagctgatctattggaggaagggagctttgacgatgctgtaagggcttgtgagggtgtcttccacattgcgtcgcctgtccttgggaaatctgattccaattgcaaggaagcaacactcggtcctgcaatcaatggtaccctcaacgtgctaagatcctgcaagaagagtccatttctcaaaagggttgttctcacatcttcatcatccgcggtaaggattagggatgaaactcagcagccagaactgttatgggatgaaacgacatggagctctgtgccactctgtgaaaagctacagctatggtatgccctggcaaaggtatttgcagagaaagcagcattggactttgccaaggagaataacattgaccttgtgacagttcttccatcattcgtaattggacccagtttatcccatgaattgtgcactactgcttcagatatccttggcttacttcaaggtgacacagacaggttcactttgtacggaaggatgggatatgttcacatcgatgatgttgcccggagccacattctagtgtacgaaacaccggaggcaactggcagatatctgtgcagctcagtggttctggataacaatgaattggttggcttactggcaaaacagtttccagtattccccattccaaggaggctcaagaacccctatggaaagcaggcataccagctagacacatccaagctccaggggctgggtctcaagttcaaaggagtgcaggagatgtttaacgactgcgtcgaatcgctgaaagatcagggccatttgctggagtgcccgttgtgataacagagacagcattgacaagccatagccaaacagcattgacaagccatagccaaacacatctcaactatgcctgaatcatgtcagttctcgagtcatagattttttttttctcttcaaataattcccatgtactctccttactataccgaacatcaattgtcagcggcagattaaatgtgtccatatgctttgcaattgtttcaattagtaatgaaatatttgaaacaaaaaaaaaaaaa

SEQ ID NO: 61 - DNA, 1439 bp, Lolium perenne
aaacgactccaacgcaccgatcgacgacacacccctgcacttcacgggtcgatcggatcggaggatggcgccggtggtggagagagcgcccttcctgccgacgggggaggccacgctgcggccgtccttcgtgcgggacgaggacgagcggcccaaggtggcgcacgaccgcttcagcgacgaggtgcccgtcatctcgctccacggcatcgacgacgcgcggaggaccgagatccgggaccgcgtggcggcggcgtgcgaggggtggggcatcttccaggtcgtcgaccacggcgtcgacgccgcgctcatcgccgagatggccaggctctcgcgcgacttcttcgcgctccccgccgaggacaagctccgctacgacatgtccggcggcaagaagggcggattcatcgtctccagccacctccagggcgagacggtccaggactggcgggagatcgtgacctacttctcgtacccggtcaaggcgcgggactacggccggtggccggacaagcccgcggggtggcgcgcggtggtggagcagtacagcgagcggctcatggcgctgtcctgcaagctgctgggggtgctgtcggaggccatgggcctggagacggaggccctgtccaaggcgtgcgtggacatggaccagaaggtggtggtcaacttctaccccaagtgcccccagcccgacctcaccctcggcctcaagcgccacaccgaccccggcaccatcaccctcctcctccaggacctcgtcggcggactccaggccacccgcgacggcggcaacacctggatcaccgtacagcccatcgccggcgcattcgtcgtcaacctcggcgaccacggccactacttgagcaacgggaggtttaagaacgcggaccaccaggcggtggtgaacggggagagcagcaggctgtccatcgccacgttccagaacccggcgcccgacgccaaggtgtggccgctggcggtgagggagggggaggacaccatcctggaggagcccatcaccttcaccgagatgtaccgccgcaagatggcgcgcgacctcgagctcgccaagcgcaagaagcaggccaaggccgatcagctcaagcagcagctgcagcaggaggccgcgcccgccgccgcgcccaccaagccactcaaccagattcttgcctagattccatgccgattcattcatgcgtgatatatagtactatgtactatatcgtattaaaataagtaattatctctatctactcatttgtgtgtaattaagagatgagtaattatctagtatatacacatttgtctgcgaggagcgagctggacctgtaataacatgtagcatgtcctacgtggaaccgatcagctgattggagctgtcacatgagtttgctgtgtgcagaaattgaacgcattcggtactgctttcaaaaaaaaaa

SEQ ID NO: 62 - DNA, 1320 bp, Festuca arundinacea
gaaacggccctgcactagacgaaccagacaaacgactccatcccacagacgactcgccggccgccacgcccacgcaccactttacggggccgatcggatcggatggcgtcggtggagaacgcgccgttcctgccgacggcggcgacgggcgaggccacgctgcggccgtccttcgtgcgggacgaggacgagcgacccaaggtggcgcacgaccgcttcagcgacgaggtgccggtcatctcgctccacggcatcgatgatggcggcgcgcggagggccgagatccgggaccgcgtggcggcggcgtgcgaagggtggggcgtcttccaggtcgtcgaccacggcgtcgacgccgccctcgtcgccgagatggccaggctctcccgcgagttcttcgcactccccgccgaggacaagctccgctacgacatgtccggcggcaagaaaggtggattcatcgtctccagccacctccagggcgagacggtccaggactggcgggagatcgtgacctacttctcgtacccggtgaaggcgcgggactacgggcggtggccggagaagcctgcggggtggcgcgcggtggtggagcagtacagcgagcggctcatggcgctgtcgtgcaagctgctgggggtgctgtcggaagccatgggcctggagacggaggccctgtccaaggcgtgcgtggacatggaccagaaggtggtggtcaacttctaccccaagtgcccccagcccgacctcaccctcgggctcaagcgccacaccgaccccggcaccatcaccctcctcctccaggacctcgtcggcggactccaggccactcgcgacggcggcaacacctggatcaccgtgcagcccgtccccggcgccttcgtcgtcaacctcggcgaccacggccactacttgagcaacgggaggtttaagaacgcggaccaccaggcggtggtcaacggggagagcagcaggctgtccatcgccacgttccagaacccggcgccagaagcgaaggtgtggccgctggcggtaagggagggggaggacaccatactggaggagcccatcaccttcaccgagatgtaccgccgcaagatggcgtgcgacctcgagctcgccaagcgcaagaagcaggccaaggccgaccagctcaagcagcagctgcagcaggagcagcaggaggcggtggccgccgccgcgcccaagcccgccaccaccaagcccctcaaccagattcttgcctagattccatgtatatgtatatcgtattaaaataagaaattatctatatatatatatatatatataaaaaaaaaaaaa

SEQ ID NO: 63 - protein, 654 aa, Lolium perenne
MESSAVVPGTTAPLLPYAYAPLPSSSDDARENRSSGGVRWRACAVVLADSALAVVVVVGLLAGGRVDRVPAGADVASATVPAVPMEFPRSRGKDLGVSEKSSGAYSADGGFPWSNAMLQWQRTGFHFQPEQHYMNDPNGPVYYGGWYHLFYQHNPKGDSWGNIAWAHAVSKDMVNWRHLPLAMVPDQWYDSNGVLTGSITVLPDGQVILLYTGNTDTLAQVQCLATPADPSDPLLREWIKHPANPILFPPPGIGLKDFRDPLTAWFDHSDHTWRTVIGSKDDDGHAGIILSYKTKDFVNYELMPGNMHRGPDGTGMYECIDLYPVGGNSSEMLGGDDSPDVLFVLKESSDDERHDYYALGRFDAVANVWTPIDRDLDLGIGLRYDWGKYYASKSFYDQKKNRRIVWAYIGETDSEQADITKGWANLMTIPRTVELDRKTRTNLIQWPVEEVDTLRRNSTDLGRITVNAGSVIRLPLHQGAQLDIEASFQLNSSDVDAINEADVGYNCSTSGAAVRGALGPFGLLVLANGRTEQTAVYFYVSKGVDGGLQTHFCHDESRSTRAKDVVNRMIGSIVPVLDGETFSVRVLVDHSIVQSFAMGGRITATSRAYPTETIYAAAGVYLFNNATGATVTAERLVVHEMASADNHIFTNDDL

SEQ ID NO: 64 - protein, 648 aa, Festuca arundinacea
MESSAVVPGTTARLLPYAYAPLPSSADDARENQGSDGVRWRACAAVLAASALAVLVVVGLLAGGRVDRPGPAAVPAVPTEIPRSRGKDFGVSEKSSGAYSADGGFPWSNAMLQWQRTGFHFQPEQHYMNDPNGPVYYGGWYHLFYQYNPKGDSWGNIAWAHAVSKDMVNWRHLPLAMVPDQWYDSNGVLTGSITVLPDGRVILLYTGNTDTLAQVQCLAEPADPSDPLLREWIKHPANPILFPPPGIGLKDFRDPLTDWFDHSDDTWRTVIGSKDDDGHAGIILSYKTKDFVNYELMPGNMHRGPDGTGMYECIDLYPVGGNSSEMLGGDDSPDVLFVLKESSDDERHDYYALGRFDAAANIWTPIDQELDLGIGLRYDWGKYYASKSFYDQRKNRRVVWAYIGETDSEQADITKGWANLMTIPRTVELDKKTRTNLIQWPVEEVDTLRRNSTDLGRITVNAGSVIRLPLHQGAQLDIEASFQLNSSDVDALNEADVGYNCSTSGAAVRGALGPFGLLVLANGRTEQTAVYFYVSKGVDGALQTHFCHDESRSTRAKDVVNRMIGSIVPVLDGETFSVRVLLDHSIVQSFAMGGRITATSRAYPTEAIYAAAGVYVFNNATGATVTAERLVVYEMASADNHIFRNDDL

SEQ ID NO: 65 - protein, 620 aa, Festuca arundinacea
MESRAFPNAAYAPLLPPTADDATLGKQDRPGVGWRGFLTVLAASGVVVLLVAATMLAGSRMGQAGDTDEDGAGGFPWSNEMLQWQRAGFHYQPEGHFMSDPDGPVYYRGYYHLFFQYNRRGVAWDDYIEWGHVVSQDLVHWRPLPLALRPDHWYDKKGVLSGTITVLHNGTLVLLYTGVTEDPMAESQCIAVPTDPNDPLLRHWTKHPANPVLAHPQGVQGMDFRDPTSAWFDKSDATWRILIGSKDDDNGSHAGIAFIFKTKDFLSFERVPGIVHRVEGTGMWECIDFYPVGGGHNSSSEELYVIKASMDDERHDYYSLGRYDAAANTWTPLDAELDLGIGLRYDWGKLYAATSFYDPLKQRRIMLGYVGETDSARADVAKGWASLQSIPRTVTLDEKTRTNLLLWPVEEVEALRYNSTDLSGITVDNGSVFHLPLHQATHLDIEASFRLDASDVAAINEADVGYNCSSSGGAAARGAIGPFGLLVHAAGDLRGEQTAVYFYVSRALDGTLRTSFCNDETRSSRARDVTKRVVGSTVPVLHGEALSMRVLVDHSIVQSFAMGGRVTATSRVYPTEAIYARAGVYLFNNATGASVTAERLIVHEMASAVYDETLIMVEDS

SEQ ID NO: 66 - protein, 623 aa, Lolium perenne
MESRAFPSAAYAPLLPSAADDVALAKQDRPGVGWRGFLTVLAACGVVVLLVGATLLAGSRMGQAGDGEGNTDEDGAGGFPWSNEMLQWQRAGFHYQPEGHFMSDPNGPVYYRGYYHLFFQYNRRGVAWDDYIEWGHVVSQDLVHWRPLPLAMRPDHWYDKKGVLSGTITVLHNGTLVLLYTGVTEDPMAESQCIAVPTDPNDPLLRHWTKHPANPVLAHPQGVQGMDFRDPTSAWWDKSDATWRILIGSKDDDNGSHAGIAFIFKTKDFLSFERVPGIVHRVEGTGMWECIDFYPVGGGHNSSSEELYVIKASMDDERHDYYSLGRYDAAANTWTPLDAELDLGIGLRYDWGKLYASTSFYDPVKQRRIMLGYVGEVDSARADVAKGWASLQSIPRTVALDEKTRTNLLLWPVEEVEALRYNSTDLSGITIDNGSVFHLPLHQTTQLDIEASFRLDASDVAAINEADVGYNCSSSGGAAARGALGPFGLLVHAAGDLRGEQTAVYFYVSRALDGTLRTSFCNDETRSSRARDVTKRVVGSTVPVLDGEALSMRVLVDHSIVQSFAMGGRTTATSRVYPTEAIYARAGVYLFNNATGAGVTAERLIVHEMASAVYDETLMVEDS

SEQ ID NO: 67 - protein, 623 aa, Festuca arundinacea
MESRAFPSAAYAPLLPPTADDATLGKQDRPGVGWRGFLTVLAASGVVVLLVAASLLAGSRMGQAGDGEGNTDEDGAGGFPWSNEMLQWQRAGFHYQPEGHFMSDPDGPVYYRGYYHLFFQYNRRGVAWDDYIEWGHVVSQDLVHWRPLPVAMRPDHWYDKKGVLSGTITVLHNGTLVLLYTGVTEDPMAESQCIAVPTDPNNPLLRHWTKHPANPVLAHPQGVQGMDFRDPTSAWFDKSDATWRILIGSKDDDNGSHAGIAFIFKTKDFLSFERVPGIVHRVEGTGMWECIDFYPVGGGHNSSSEELYVIKASMDDERHDYYSLGRYDAAANTWTPLDAELDLGIGLRYDWGKLYAATSFYDPLKQRRIMLGYVGETDSARADVAKGWASLQSIPRTVTLDEKTRTNLLLWPVEEVEALRYNSTDLSGITIDNGSVFHLPLHQATQLDIEASFRLDASDVAAINEADVGYNCSSSGGAAARGAIGPFGLLVHAAGDLRGEQTAVYFYVSRALDGTLRTSFCNDETRSSRARDVTKRVVGSTVPVLDGEALSMRVLVDHSIVQSFAMGGRVTATSRVYPTEAIYARAGVYLFNNATGASVTAERLIVHEMASAVYDETLMVQDS

SEQ ID NO: 68 - protein, 619 aa, Lolium perenne
MESRDFPSAAYAPLLPSAADDVALAKQDRPGVGWRGFLTVLAACGVVVLLVAASLLAGSRMGQAGDTDEDGAGGFPWSNEMLQWQRAGFHYQPEGHFMSDPDGPVYYRGYYHLFFQYNRRGVAWDDYIEWGHVVSQDLVHWRPLPLAMRPDHWYDKKGVLSGTITVLHNGTLVLLYTGVTEDPMAESQCIAVPTDPNDPLLRHWTKHPANPVLAHPQGVQGMDFRDPTSAWWDKSDSTWRILIGSKDDDNGSHAGIAFIFKTKDFLIFERVPGIVHRVEGTGMWECIDFYPVGGGHNSSSEELYVIKASMDDERHDYYSLGRYDAAANTWTPLDAELDLGIGLRYDWGKLYASTSFYDPLKQRRIMLGYVGDVDSARADVAKGWASLQSIPRTVALDEKTRTNLLLWPVEEVEALRYNSTDLSGITVENGSIFHLPLHQATQLDIEASFRLDASDVAAINEADVGYNCSSSGGAAARGALGPFGLLVHAAGDLRGEQTAVYFYVSRALDGSLRTSFCNDETRSSRARDVAKRVVGSTVPVLDGEVLAMRVLVDHSIVQSFAMGGRVTATSRVYPTEAIYARAGVYLFNNATGASVTAERLIVHEMASAVYDETVMVKDS

SEQ ID NO: 69 - protein, 422 aa, Festuca arundinacea
MDKLNGSARLMIVSDLDHTMVDHHDEENLSLLRFGALWESAYCQDSLLVFSTGRSPTLYKELRKEKPMLTPDITIMSVGSEITYGEAMVPDDGWEEYLNNKWDRNIVLEETAKYSELKLQPETEQRPHKVSFLVDKKSAQEVIKSLSEKFEKRGVDAKIIYSGGQDLDILAQGAGKGQALAYLLKKFASCGKTPNNTLVCGDSGNDAELFSIPGVHGVMVSNAQEELLQWHAENAKDNPKVIHATERCAAGIIQAIGHFKLGPNISPRDIEFPYVKEDSFKPTAAVVKFYVLCEKWRRADVPKADSVIEYFKNITDASGVIIHPSGLELSIHSSIDALASCYGDKQGKKYRSWVDRLVISQTASDSWLVRFDLWEAEGDAWVCCLTTLALNVKPETPGGFVVTHIHKTWLKEYSGDEQASKL

SEQ ID NO: 70 - protein, 422 aa, Lolium perenne
MDKLNGSARLMIVSDLDHTMVDHHDEENLSLLRFGALWESTYCQDSLLVFSTGRSPTLYKELRKEKPMLTPDITIMSVGSEITYGEAMVPDDGWEEYLNNKWDKSIVLEETAKFSELKLQAETEQRPHKVSFLVDKKTAQEVIKSLSEKFEKRGVDAKIIYSGGQDLDILAQGAGKGQALAYLLKKFASCGKTPNNTLVCGDSGNDAELFSIPGVHGVMVSNAQEELLQWRAENAKDNPKVIHATERCAAGIIQAIGHFKLGPNVSPRDVEFPYVKEDSFKPTAAVVKFYVLCEKWRRADVPKTDSVIEYFKNITDASGVIIHPSGLELSIHSSIDALASCYGDKQGKKYRSWVDRLVISQTASDSWLVRFDLWEAEGDKWVCCLTTLALNVKPETPGGFVVTHIHKTWLKEYSGDEQASKL

SEQ ID NO: 71 - protein, 1062 aa, Festuca arundinacea
MAAGNEWINGYLEAILDAGSKLRPQGVQLPPLETAPALAAEESGAAYNPTRYFVEEVVRSFDEQALHKTWTKVVAMRNSQERSNRLENLCWRIWNVSRQKKQVEWDYTKEVARRKLEQELGSREAAEDLSELSEGEKDTTTAKPDAATAQPSTDDGEHQQPQPRTRLARINSEVRLVSDDEEEQTKKRNLYIVLISIHGLVRGENMELGRDSDTGGQVKYVVELARALAATAGVHRVDLLTRQISCPDVDWTYGEPVEMLERLSSADADEDDGEQSGGGAYIVRLPCGPRDQYIPKEELWPHIPEFVDRALSHVTEVARALGDQLQPPPTPAAGDGAALVAAPIWPYVIHGHYADAAEVAANLASALNVPMVMTGHSLGRNKLEQLLKLGRMPGPEIQGTYKIARRIEAEETGLDTAEMVVTSTKQEIEEQWGLYDGFDLMVERKLRVRQRRGVSSLGRYMPRMAVIPPGMDFSFVETQDTAEGDGADLQMLIAPDKAKKALPPIWSDVLRFFTNPHKPMILALSRPDPKKNVTTLLKAYGESRQLRELANLTLILGNRDDIEDMAGGGGAVLTAVLKLIDRYDLYGQVAYPKHHKQTDVPHIYRLAAKTKGVFTNPALVEPFGLTIIEAAAYGLPVVATKNGGPVDILKALNNGLLVDPHSAEAITGALLSLLAEKSRWVECRRNGLRNIHRFSWPHHCRLYLSHVSTYCDQPSPHQPLRVPLGLGSSTSFGADDSLSDSLRGLSLQISVDASSDLNAADSAAAIMDALRRRPASEKPASSGARALGFAPGRRESLLVVAVDCYGDDGKPDVKQLKKAIDAAVSVGECAGAKQGYVLSTGMTIPEAAEAIKACGADVASFDALICSSGAELCYPWKELAADEEYSGHVAFRWPGDHVKSAVPRLGSLEEIALAIDRPACSVHCHAYAATDASKVKKVDSIRKSLRMRGFRCNLVYTRACTRLNVIPLSASRPRALRYLSIQWGIDLSKVAVLVGETGDTDRERLLPGVHKTLILPGMVARGSEELLRGDDGYTMADVVAMDSPNIVTLAEGQSASDLLKAI

SEQ ID NO: 72 - protein, 1074 aa, Lolium perenne
MAGNDWINSYLEAILDAGGTAGDISAASVAGGDDGPGAGGGTAGEKRDKSSLMLRERGRFNPARYFVEEVISGFDETDLYKTWVRTSAMRSPQERNTRLENMSWRIWNLARKKKQIEGEEASRLSKKRLEREKARRDAAADLSEDLSEGEKGENINGSSVHDESTRGRMPRIGSTDAIEVWANQHKDKKLYIVLISIHGLIRGENMELGRDSDTGGQVKYVVELARALGETPGVYRVDLLTRQISAPDVDWSYGEPTEMLSPRNSENLGDDMGESSGAYIVRIPFGPREKYIPKEQLWPHIQEFVDGALVHIMQMSKVLGEQVGRERRVWPVVIHGHYADAGDSAALLSGALNVPMVFTGHSLGRDKLEQLLKQGRQTRDEVNATYKIMRRIEAEELCLDASEIVITSTRQEIEKQWGLYNGFDVTMERKLRARTKRGVSCYGRYMPRMIAIPPGMEFSHIVPHDVDLDGDEANEVGSGSPDPPIWADIMRFFSNPRKPMILALARPDPKKNITTLVKAFGEHPGLRNLANLTLIMGNRDVIDEMSSTNGAVLTSVLKLIDKYDLYGQVAYPKHHKQSEVPDIYRLAARTKGVFINCAYIEPFGLTLIEAAAYGLPMVATQNGGPVDIHRVLDNGILVDPHNQNDIAEALYKLVSDKHLWAQCRQNGLDNIHRFSWPEHCKNYLSRVGTVKPRHPRWQRSDDATEVSESDSPGDSLRDVHDISLNLKLSLDSEKAGTKINTERNSTNARRNLEDAVLKFSNAVSEGTKDESDENAEATTGSINGHLYGEKHIVVIAVDSVQNADLVQIIKNLFEASRKEKSSGAVGFVLSTSRAISETLTFLTSGGIQTTEFDAFICSSGSDLCYPSSSSEDMLSPTELPFMIDLDYHSQIEYRWGGEGLRKTLIRWAAENNSQSGQEVVTEDEECSSTYCISFKVKNTEAVPPVKDLRKTMRIQALRCHVLYSHDGSKLNLIPLLASRSQALRYLYIRWGVELANMTVVVGESGDTDYEGLLGGVHKTIILKGSFNAAPNQLHAARSYSLEDVISFDKPGIASVEGYLPDSLKSALQQFGVLN

SEQ ID NO: 73 - protein, 937 aa, Lolium perenne
MAAGNEWINGYLEAILDAGSKLRPQGVQLPPLETAPALAAEESSAAYNPTRYFVEEVVRSFDEQALHKTWTKVVAMRNSQERSNRLENLCWRIWNVSRQKKQVEWDYTKEVARRKLEQELGSREAAEDLSELSEGEKDTTTAKPDAAAAQPSADDGEHQQPQPRTRLARINSEVRLVSDDEEEQTKKRNLYIVLISIHGLVRGENMELGRDSDTGGQVKYVVELARALAATAGVHRVDLLTRQISCPDVDWTYGEPVEMLERLSSADADDDDGEQAGGGAYIVRLPCGPRDQYIPKEELWPHIPEFVDRALSHVTEVARALGEQLQPPPSPADGAVAAPIWPYVIHGHYADAAEVAANLASALNVPMVMTGHSLGRNKLEQLLKLGRMPGPEIQGTYKIARRIEAEETGLDTAEMVVTSTKQEIEEQWGLYDGFDLMVERKLRVRQRRGVSSLGRYMPRMAVIPPGMDFSFVETQDTADGTGRSQMLIAPDKAKKALPPIWSDVLRFFTNPHKPMILALSRPDPKKNVTTLLKAYGESRQLRELANLTLILGNRDDIEDMAGGGGAVLTAVLKLIDRYDLYGQVAYPKHHKQTDVPHIYRLAAKTKGVFINPALVEPFGLTIIEAAAYGLPVVATKNGGPVDILKALHNGLLVDPHSAEAITGALLSLLAEKSRWVECRRNGLRNIHRFSWPHHCRLYLSHVSTYCDQPSPHQPLRVPLALGSSTSFGADDSLSDSLRGLSLQISVDASSDLNAADSAAAIMDALRRRPASEKPASSGARALGFAPGRRESLLVVAVDCYGDDGKPDVEQLKKAIDAAVSVGECAGAKQGYVLSTGMTIPEAAEAIKACGADVASFDALICSSGAELCYPWKKLVADEEYSGHVAFRWPGDHVKSAVPRLGSMEEIALAIDRPASSVHCHAYAATDASKVSITEHYL

SEQ ID NO: 74 - protein, 808 aa, Lolium perenne
MAAKLTRLHSLRERLGATFSSHPNELIALFSKYVHQGKGMLQRHQLLTEFEALFEADKERYAPFEDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNHQGTTMMLNDRIQSLRGLQSALRKAEEYLTSIPEDTPSSEFNHRFQELGLEKGWGDTAKRVQDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTEKGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHPEIEELLYSDVENSEHKFVLKDKNKPIIFSMARLDRVKNMTGLVEMFGKNAHLKDLANLVIVAGDHGKESKDREEQAEFKRMYSLIEEYKLEGHIRWISAQMNRVRNAELYRYICDTKGAFVQPAFYEAFGLTVVEAMTCGLPTIATCHGGPAEIIVNGVSGLHIDPYHSDKAADILVNFFEKSTADPTYWDKMSEGGLKRIYEKYTWKLYSERLMTLTGVYGFWKYVSNLERRETRRYLEMFYALKYRSLAAAVPLAVDGENTDN

SEQ ID NO: 75 - protein, 808 aa, Festuca arundinacea
MAAKLTRLHSLRERLGATFSSHPNELIALFSKYVHQGKGMLQRHQLLTEFEALFESDKERYAPFQDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNHKGTTMMLNDRITSLRGLQSALRKAEEYLTSILEDTPSFEFNHRFQELGLEKGWGDTAKRVQDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTEKGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMSVYFPYTETDKRLTAFHPEIEELLYSDVENSEHKFVLKDKNKPIIFSMARLDRVKNMTGLVEMFGKNAHLKDLANLVIVAGDHGKESKDREEQAEFKRMYSLIEEYKLKGHIRWISAQMNRVRNAELYRYICDTKGAFVQPAFYEAFGLTVIEAMTCGLPTIATCHGGPAEIIVDGVSGLHIDPYHSDKAADILVNFFEKSTADPTYWDKMSEGGLKRIYEKYTWKLYSERLMTLTGVYGFWKYVSNLERRETRRYLEMFYALKYRSLAAAVPLAVDGENTDS

SEQ ID NO: 76 - protein, 814 aa, Lolium perenne
MGEAAGDRVLSRLHSVRERIGDSLSAHPNELVAVFTRLVNLGKGMLQPHQIIAEYNTAIPEAEREKLKDGAFEDVLRAAQEAIVISPWVALAIRPRPGVWEYVRVNVSELAVEELSVPEYLQFKEQLVEGSNKDFVLELDFEPFNASFPRPSLSKSIGNGVQFLNRHLSSKLFHDKESMYPLLNFLRAHNYKGMPMMMNDRVRSLSALQGALRKAEEHLSGLPADTPYSDFHHRFQELGLEKGWGDCAKRAQETLHLLLDLLEAPDPSTLEKFLGTIPMVFNVVILSPHGYFAQANVLGYPDTGGQVVYILDQVRAMENEMLLRIKQQGLDITPRILIVTRLLPDATGTTCGQRLEKVLGTEHTHILRVPFRTENGIVRKWISRFEVWPYLETFTDDVAHEISGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGMYRVVHGIDVFDPKFNIVSPGADMSIYFPYSESQRRLTSLHPEIEELLYSDVDNDEHSCLKDRNKPIIFSMARLDRVKNLTGLVELYGRNPRLQELVNLVVVCGDHGNPSKDKEEQAEFKKMFDLIEQYNLNGHIRWISAQMNRVRNAELYRYICDTKGAFVQPAFYEAFGLTVIEAMTCGLPTFATAYGGPAEIIVNGVSGYHIDPYQGDKASALLVEFFEKCQGDHSHWTKISLGGLQRIEEKYTWKLYSERLMTLTGVYGFWKYVSNLERRETRRYLEMLYALKYRTMASTVPLAVEGEPSSK

SEQ ID NO: 77 - protein, 816 aa, Festuca arundinacea
MGESAGERALSRLHSVRERIGDSLSAHTNELVAVFSRLVNHGKGMLQPHQITAEYNAAIPEAEREKLKDTAFEDLLRGAQEAIVIPPWVALAIRPRPGVWEYVRVNVSELGVEELSVPEYLQFKEQLVNESTDNNFVLELDFGPFNASFPRPSLSKSIGNGVQFLNRHLSSKLFHDKESMYPLLNFLRAHNYKGMTMMLNDRIRSLSALQDALRKAEKHLSGLPADTPYSEFHHRFQELGLEKGWGDCTQRAHETIHLLLDLLEAPDPSTLEKFLGTIPMVFNVVILSPHGYFAQANVLGYPDTGGQVVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQANPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMTIYFPYTEQQKRLTSLHAEIEELLFSDVENSEHKFVLKDKNKPIIFSMARLDRVKNMTGLVELYGRNPRLQELVNLVVVCGDHGKESKDKEEQAEFKRMFDLIEQYNLSSHIRWISAQMNRVRNGELYRYICDMKGAFVQPAFYEAFGLTVIEAMTCGLPTFATAYGGPAEIIVNGVSGYHIDPYQNDKASALLVEFFEKCQEDPSHWNKISQGGLQRIEEKYTWKLYSERLMTLSGVYGFWKYVSNLDRRETRRYLEMLYALKYRKMATTVPLAIEGETTGK

SEQ ID NO: 78 - protein, 478 aa, Festuca arundinacea
WIILEPAIEPDTPGDIKGCWSASATVISGSQPVIMYTGGDVENHQVQNIALPKNRSDPYLIEWTKACNNPVLQPVGPGMNPGEFRDPTTGWIGPDGLWRISIGAEVNGYSAALLYKSEDFLNWSRVDHPLYSSSASTMWECLDFFAVLPGSNGGLDLSAAIPKGAKHVLKVSVDQCDKYMIGVYDLEHDAFVPDTILDDRWLLPRIDYGNYYASKSFFDSKNRRRIIWGWTNESDSSSDDVAKGWAGIYAIPRTIWLDRDGKQLLQWPVEEIESLRRNEINYQGLDLEKGDLYEIKGVDTLQADVEIDFELTSIDDADSFDPSWLLDPEKHCREAGASVHGGIGPFGLVILATGDMEEHTVVHFRVYKSQKEYMILMCSDIRRSSLRQGLYAPAYGGFFEFDLEKERKISLRTLIDRSAVESFGGGGRVCIIARVYPVAIVDDGSAHMYAFNNGSTTVRVPQIRAWSMMTAQVNLKKG

SEQ ID NO: 79 - protein, 583 aa, Lolium perenne
MGNPKWVLAPWAVLLLLQLASASHHARLSLETSAASPSVPASIVSPLLRTGYHFQPPMNWINDPNGPLYYKGWYHLFYQYNPKGAVWGNIIWAHSVSRDLINWIALEPAISPTIPTDQYGVWSGSTTILHDGTPAILYTGIDRPSVNYQIQNIALPKNASDPLLREWYKPGYNPIAVPVEGINATQFRDPTTAWFAGRHWRMLVGGLRPGTLRGEAILYRSRDFKHWVRAKHPLHSALTGMWECPDFFPVGKAGVEKGLDTSEYGAAAGVEKHVLKNSLDLTRYDYYTIGTYDNVKERYVPDNPTGDVYQRLQYDYGNFYASKTFFDPVKQRRILLGWANESDSVAHDKAKGWAGIQAIPRKIWLDPSGKQLVQWPVEELEKLRGKPVNVGDKVVKPGQHFEVTGLQSYQSDVEVSFEVSSLDKAEPFDPAYSNDAQKLCGIKGADVKGGVGPFGLWVLSSADLAEKTAVFFRVFKDGYGKPIVLMCSDPTKSSLTPDLYKPTFAGFVDTDISSGKISLRSLIDRSVVESFGAGGKTCILSRVYPSMALGKDAHLHVFNNGETDIKVSKLTAWEMKRPLMNGA

SEQ ID NO: 80 - protein, 390 aa, Lolium perenne
GVGSLLVYRSADFLRWQRNAAPLHASSRDVPVLECPDLFPVAAAAQGATEGLETSAPSGAGVRHVLKLTDFAKEDHYMVGFYDDVADTFVPAEPERGDDPDNWRRLDHGHLYASKSFYDARNKRRILWAWVDETDGGGVARGWAGIQAFPRAMWLDADGKRLVQWPVEEIETLRRKRVGLRWATDVEAGGRKEIAGIVSSQADVEVVFEIPNLEEAETLDPEWVLDPKGLCAAKGASVHGGVGPFGLLVLASGDLEEHTAVFFRVFKHDGKYKVLMCTDLTKSSTKAGAHKPSYGAFLDVDVEKDKFISLRTLIDHTVVESFGDGGRTCMTARVYPEHAAMGSTHLYVFNNGTGAVKVSKLEAWELATAAVNGGSLAPVVVKASDPKEAL

SEQ ID NO: 81 - protein, 597 aa, Festuca arundinacea
MAGLRLAACAAVAVLLCLLLSSSAALRWLSDPAPESAAAGVSHDSYRTAYHFQPTENWQNDPNGPMYYKGVYHFFYQYNPYRATWGNGNLSWGHSVSVDLVNWSALENAMDPDSSFDINGCWSGSATILPDGTPVFLYTGIDADNNQVQNVAFPKNASDPLLREWVKPSYNPVIALPDDVVHDNFRDPSTAWLGRDGLWRVAVSAGLKDGTGTTLVYRSKDFRQWERNAEPLYSSSDAGMVECPDLFPLAEPGDQHGLDYTPSNGAAVSYVLKQSVMDTLSDYYVLGRYDDAADTFSPVEADNDCRTWQRFDYGHVYASKSFYDAGKKRRVLWSWANESDPEADYLARGWAGVQAVPRRIWLDSKGKQLLQWPIEEIETLRKTRVGLLGAEMNAGGMNEIIGVAGAQADVEVVFEVPSLEGAENLDPNQLLDPQRLCGEKGASVLGGVGPFGLLVLASGDLQEHTSVFFRVFRHEGKYKVLMCTDLRRSTTRADVYKPPYGGFVDIDIEKERSISLRTLVDHSVVESYGGGGRTVITARVYPEHAATTNSRLFMFNNGTGAVKVSKLDAWELAPAKVNVPGDGLITAGSSMHLREAY

SEQ ID NO: 82 - protein, 399 aa, Festuca arundinacea
LNSTEFRDPTTGWIGPDGLWRIAIGAELNGYGAALLYKSEDFLNWTRVDHPLYSDNAPSMWECPDFFAVLPGNNGGLDLSAAIPKGAKHVLKMSVDYSDKYMIGVYDLKRDAFVPDVVLDDRRLWLRIDYGTFYASKSFFDSKRGRRVIWGWSNETDSVSDDGAKGWAGIHAIPRSIWLDSDGKQLLQWPIDEIESLRRDEINHQGLELKNGDLFEIKGIDTLQADIEVDFELTSIDSADPFDPSWLLDVERHCREAGASVQGGIGPFGLVVLASDNMEEHIAVHFRVYKSQKSHMILMCSDLRRSSLRSGLYTPAYGGFFEFDLEKERKISLRTLIDRSAVESFGGGGRVCITARIYPVALVDGRVHMYAFNNGSTTVRVPQLGAWSMMTAQVNVNKG

SEQ ID NO: 83 - protein, 583 aa, Festuca arundinacea
MGNPKWIFAPWAVLLLFLLQLACASHHTRRSLETEAASPSVPASIVSPLLRTGYHFQPPMNWINDPNGPLYYKGWYHLFYQYNPKGAVWGNIIWAHSVSRDLINWIALEPAITPSIPTDKYGVWSGSTTILHDGTPAILYTGIDRPSINYQIQNIALPKNASDPLLREWYKPGYNPIAVPVAGMNATQFRDPTTAWFAGRHWRMLVGGLRPGTLRGEAILYRSLDFKNWTRAHHPLHSALTGMWECPDFFPVGEAGVEKGLDTSEHGEGVEKHVLKNSLDLTRYDYYTVGTYDNVKERYVPDNPTGDVYRRLQYDYGNFYASKTFFDPVKQRRILLGWANESDSVAHDKAKGWAGIQAIPRKIWLDPSGKQLVQWPVEELEKLRGKPVTVGDKVVKPGQHFEVTGLQSYQSDVEVSFEVSSLDKAEPFDPAYSNDAQKLCGIKGADANGGVGPFGLVVLASADLAEKTAVFFRVFKDGYGKPIVLMCSDPTKSSLTPDLYKPTFAGFVDTDISSGKISLRSLIDRSVVESFGAGGKTCILSRVYPSMALGKNAHLHVFNNGETDIKVSKLTVWEMKRPLMNGA

SEQ ID NO: 84 - protein, 346 aa, Lolium perenne
MYYNGIYHEFYQYNPNGSLWGNIIWGHSVSTDLINWIPVEPAIERDIPSDINGCWTGSATIISGDQPIIIYTGADKENRQLQNIVLPKNKSDPYLREWTKAGNNPVIQPVGPGLNASQFRDPTTGWIGPDGLWRIAVGAELNGYGAALLYKSQDFLNWTRVDHPLYSSNASSMWECPDFFAVLPGNSGGLDLSAEIPNGAKHVLKMSLDSCDKYMIGVYDLKSDTFMPDSVLDDRRLWSRIDHGNFYASKSFFDSKKGRRIIWGWTNETDSSSDDVAKGWAGIHAIPRTIWLDSYGKQLLQWPIEEIESLRRNEISHQGLELKKGDLFEIKGTDTSQVVHVFLGKL

SEQ ID NO: 85 - protein, 581 aa, Festuca arundinacea
MAGLRLAAVAFHLCLLLSPSSSLRRLYHEDDEAESTPGHGGSRTAYHFQPAKNWQNDPNGPMYHNGLYHLFYQYNPRGATWGNGNLSWGHSVSVDLVNWAALDTALDPDSPFDANGCWSGSATILPDGQPAILYTGIDAAGNQVQNVAFPKKASDPLLREWVKPDYNPVIPLPKDVVHDSFRDPSTAWRGRDGLWRVAIAAKVNVTVTVGSTLIYRSKDFRRWERNAAPLYESLAAGMVECPDLFPVAKPGAQNGLDYAPSSRAARHVLKLSVVATLQDYYVVGLYDDTADTFNAAAGADNDWRTWRRIDYGHVYASKSFFDARKNRRVLWCWANESDTEADYIARGWSGVQTVPRKIWLDIDGKQLLQWPIKEIETLRKKRVGLLGTEMNSGGLNEIIGVAGSQADVEVVFKIPTLEGAENIEPNELLDPQKLCGNNGASMRGSIGPFGLLLLASGDLLEHTSVFFRVFKHGAKYKVLMCTDLTRSTTRSDVYKPSYGGFVDMDIDKTKSISLRTLIDHSVVESFGGGGRTCITARVYPEHAEMSNSHIYMFNNGTGAVKVAKLEAWELATANVNVAGHG

SEQ ID NO: 86 - protein, 588 aa, Lolium perenne
MGVRLGRVAWACPAVLVLLLQLAGASHVVYETSLLETEAAAATVPASIFELSTGYHFRPQKNWINDPNAPLYYKGWYHLFFQYNPKGAVWGNIVWAHSVSRDLINWVALETALAPSIDADKYGCWSGSATIMPDGTPVIMYTGVSRPDVNYEVQNVAFPKNSSDPLLREWVKPAHNPVIVPEGGINATQFRDPTTAWYADGHWRILVGALSGASRGVAYVYRSRDFRRWTRVRKPLHSAPTGMWECPDFYPVTVDGKESGVDTSVVSSSRVKHVLKNSLDLRRYDYYTVGTYDRLKERYVPDNPAGDKHHLRYDYGNFYASKTFYDPSKRRRILWGWANESDTAVDDVAKGWAGIQAIPRKVWLDPSGRQLMQWPVEEVKALRGKKPVSLKDRMVKRGEHVEVTGLQTAQADVEVSFEVPSLEGAEALDPALANDAQKLCGVKGADVEGGVGPFGLWVLASSKLEERTAVFFRVFKAAGNVNSTKPLVLMCSDPTKSSLNKNLYHPTFAGFVDIDMAKGKISLRSLIDQSVVESFGAGGRTCILSRVYPSLAIGRNAHLHVFNNGKADIKVSRLTAWEMKKPALMNGA

SEQ ID NO: 87 - protein, 668 aa, Lolium perenne
MEARDGVSMPYSYAALPEDAEAAVVGRGRRTGPLFAALLLTLVAALLAVAALAGVRLVGELPAGGVVMPNHPMEVMDVSGSRGPESGVSEKTSGAASESGGMLGADAGSNAFPWSNAMLQWQRTGFHFQPEKNWMNDPNGPVYYKGWYHLFYQYNPEGAIWGNKIAWGHAVSRDMLRWRHLPIAMFPDQWYDINGAWSGSATVLPDGRIVMLYTGSTNASVQVQCLAFPSDPSDPLLTNWTKYEGNPVLYPPPHVGEKDFRDPTTAWYDGSDGMWRIVIGSKDNRRAGMALTYKTKNFHDFELVPGVLHRVPATGMWECIDLYPVGGARGIDMTEAVAAASNSGGGEVLHVMKESSDDDRHDYYALGRYDAATNKWTPLDADADVGIGLRYDWGKFYASKTFYDPAKKRRVLWGWVGETDSERADVAKGWASLQSIPRTVVLDTKTGSNLIQWPVVEVETLRTNSTNLGSIIVEHGSVFPLSLHRATQLDIEASFRLDPLDVAAAKEADVGYNCSTSGGAAGRGALGPFGLLVLADARRHGGDTEQTAVYFYVARGLDGNLRTHFCHDESRSSRANDIVKRVVGNIVPVLDGKALSVRVLVAHSIVESFAQGGRSVVTSRVYPTEAIYANAGVYLFNNATGARVPATSLVVHKMDPSYNQNQAEMASL

SEQ ID NO: 88 - protein, 473 aa, Lolium perenne
VHWRHLPLAMVPDQWYDINGVWTGSATVFPDGTLNMLYTGSTNASVQAQCLAVPEDPNDSLLRNWTKHEANPVLLPPPGIGDKDFRDPTTAWFDESDQTWRTVIGSKDNNGHAGIAMVYKTKDFLNYELIPGYLHRVDGTGMWECIDFYPVGGKNGSEELYVIKESSDDDRHDWYTLGKYDAAANTFTAADPENDLGIGLRYDWGKFYASKTFYDPAKKRRVLWGWIGETDSERADVAKGWASLMSIPRTVELDEKTWTNLIQWPVEEIETLRIKSTDLGGITIDHGSVYPLPLHRATQLDIEASFRLDAATVAALNEADVGYNCSTSGGSTHRGALGPFGILVLADGKAEQTAVYFYVSKGLDGALETHFCHDESRSTLAKDVVKRVVGYTVPVLDGEAFSVRVLVDHSIVESFAMGGRSTATSRVYPTESIYGAAGAYLFNNATGGSVTVEKLVVHEMDSSYNQIFMADDL

SEQ ID NO: 89 - protein, 539 aa, Lolium perenne
IFRSRLPDIDIPTHMPLHDYCFATAASAPDAPCLITAATGRTYTFAETHLLCRKAAAALHGLGVRHGDRIMVLLQNSVEFALAFFGASMLGAVSTAANPFCTPQEIHKQLVASGAKLVVTQSAYVDKLRHEAFPRIGEALTVITIDDDGTPDGCQPFWGLVSAADENSVPESPISPDDAVALPYSSGTTGLPKGVVLTHGGLVSSVAQQVDGENPNLHMRAGEDVVLCVLPLFHIFSLNSVLLCALRAGAAVMLMPRFEMGAMLEGIERWRVTVAAVVPPLVLALAKNPGVEKHDLSSIRIVLSGAAPLGKELEDALRGRLPQAIFGQGYGMTEAGPVLSMCPAFAREPTPAKSGSCGTVVRNAELKVVDPDTGVSLGRNLPGEICIRGPQIMKGYLNDPVATAATIDVEGWLHTGDIGYVDDDDEVFIVDRVKELIKFKGFQVPPAELEALLIAHPSIADAAVVPQKDDAAGEVPVAFVVRAADSDIAEEAIKEFVSKQVVFYKRLHKVYFTHAIPKSASGKILRKELRAKLAAPATA

SEQ ID NO: 90 - protein, 559 aa, Lolium perenne
MGSIAADLAPEAPAELVFRSKLPDIEIPTHLTLQDYCFERLPELSARACLIDGATGAALTYGEVDALSRRCAAGLRRLGVRKGDVVMALLRNCPEFAFVFLGAARLGAATTTANPFYTPHEIHRQAAAAGAKVIVTEACAVEKVRAFAAERGIPVVSVDEAVDDGCLPFAATLLGEESGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRAHGVTVAPFVPPIVVEIAKSARVTAADLASIRLVMSGAAPMGKELQDAFMAKIPNAVLGQGYGMTEAGPVLAMCLAFAKEPFEVKSGSCGTVVRNAELKIVDPDTGASLGRNLPGEICIRGKQIMKGYLNDPEATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPGSDTTQSKN

SEQ ID NO: 91 - protein, 559 aa, Festuca arundinacea
MGSIAADAPEAPPAELVFRSKLPDIEIPTHLTLQDYCFQRLPEHSARACLIDGATGAALTYGEVDALSRRCAAGLRRLGVRKGDVVMALLRNCPEFAFVFLGAARLGAATTTANPFYTPHEIHRQATAAGAKVIVTEACAVEKVRAFAAERGITVVSVDEGVDDGCLPFGETLLGEDGGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRAHGVTVAPFVPPIVVEIAKSARVTAADLASIRLVMSGAAPMGKELQDAFMAKIPNAVLGQGYGMTEAGPVLAMCLAFAKEPFEVKSGSCGTVVRNAELKIVDPDTGASLGRNLPGEICIRGKQIMKGYLNDPEATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPGSETTQSKS

SEQ ID NO: 92 - protein, 557 aa, Lolium perenne
MGSVPEESVVSVAAAETVFRSKLPDIEINNEQTLQSYCFEKMAEVASRPCIIDGQTGASYTYTEVDYLTRRAAAGLRRMGVGKGDVVMNLLRNCPEFAFSFLGAARLGAATTTANPFYTPHEIHRQAEAAGAKLIVTEACAVEKVLEFAAGRGLPVVTVDGRRDGCVDFAELIAGEELPEADEAGILPDDVVALPYSSGTTGLPKGVMLTHRSLVTSVAQLVDGSNPNVCFNKDDALLCLLPLFHIYSLHTVLLAGLRVGAAIVIMRKFDVGALVDLVRAHRITIAPFVPPIVVEIAKSDRVGADDLASIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEITENEIKQFVSKEVVFYKRINKVYFTDSIPKNPSGKIVRKDLRARLAAGIPTEVAAPRS

SEQ ID NO: 93 - protein, 557 aa, Festuca arundinacea
MGSVPEESVVAAAVAETVFRSKLPDIEINNEQTLQSYCFEKMAEVASRPCIIDGQTGASYTYTEVESLTRRAAAGLRRMGVGKGDVVMNLLRNCPEFAFSFLGAARLGAATTTANPFYTPHEIHRQAEAAGAKVIVTEACAVEKVLEFAAERGLPVVTVDGKRDGCVDFAELIAGEELPEAEEAGILPDDVVALPYSSGTTGLPKGVMLTHRSLVTSVAQLFDGSNPNVCFNKDDALLCLLPLFHIYSLHTVLLAGLRVGAAIVIMRKFDVGALVDLVRAHRITIAPFVPPIVVEIAKSDRVTADDLTSIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEITENDIKQFVSKEVVFYKRINKVYFTDSIPKNPSGKILRKDLRARLAAGIPTEVAAPRS

SEQ ID NO: 94 - protein, 501 aa, Lolium perenne
MEVLLLEKALLGLFAAAVLAIAVAKLAGKRFRLPPGPSGAPIVGNWLQVGDDLNHRNLMGIAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPAFATAGTVIRRRLQLMMYNDMFRIMFDRRFESVDDPLFNKLKAMNAERSILSQSFDYNYGDFIPILRPFLRKYLNRCTNLTTKRMKLFEDHFVADRKKALEQNGEIRCAMDHILEAERKGEINHDNVLYIVENINVAAIETTLWSIEWGIAELVNHPDVQSKLRDEMTAVLGADVAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIVLALPIIGITLGRLVQNFQLLPPPGQDKIDTTEKPGQFSNQILKHATVVCKPLEA

SEQ ID NO: 95 - protein, 505 aa, Festuca arundinacea
MDFVFVEKLLVGLLASVVVAIVVSKIRGRKLRLPPGPIPVPIFGNWLQVGDDLNHRNLAAMARKFGEVFLLRMGIRNLVVVSSPELAKEVLHTQGVEFGSRTRNVVFDIFTGKGQDMVFTVYGDHWRKMRRIMTVPFFTNKVVQQYRAGWEAEAAFVVDNVRADPKAATDGVVLRRHLQLMMYNNMYRIMFDRRFESMDDPLFLRLRALNGERSRLAQSFEYNYGDFIPVLRPFLRGYLGLCEQVKETRLKLFKDYFLDERKKLASTKSMDTNGLKCAIDHILEAQEKGEINEDNVLYIIENINVAAIETTLWSIEWGIAELVNHPEIQQKLRDEMDAVLGAGHQITEPDTHKLPYLQAVIKETLRLRMAIPLLVPHMNLHDAKLAGYNIPAESKILVNAWFLANNPEQWKRPDEFRPERFLEEEKHVEASGNDFRFLPFGVGRRSCPGIILALPILGITIGRLVQNFELTTPPGVDKLDTTEKGGQFSLHILNHSTIVAKPRVF

SEQ ID NO: 96 - protein, 361 aa, Lolium perenne
MGIVNASEKTITGWAARDATGHLSPYTYNLRRTGAEDVVLKVLYCGICHTDLHQTKNHLGAPKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVDKGLTSQIEVVKMDYLNQALERLERNDVRYRFVVDVAGSNIDDTAA

SEQ ID NO: 97 - protein, 361 aa, Festuca arundinacea
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCHDCRPCKANVEQYCNKKIWSYNDVYTDGKPTQGGFASAMVVDQKFAVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGLTSQIEVVKMDYLNHALERLERNDVRYRFVVDVAGSNIKDADA

SEQ ID NO: 98 - protein, 265 aa, Lolium perenne
MATTAADATATVAKEQTTTNGAASGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDELLEDEANHGTFDFVFVDADKDNYLNYHQRLMKLVRVGGLLGYDNTLWNGSVVLPADAPMRKYIRYYRDFVLELNKALAADDRVEICQLPVGDGITLCRRAK

SEQ ID NO: 99 - protein, 265 aa, Festuca arundinacea
MATTAADATATVPKEQPATNGAASGAEQVTRHSEVGHKSLLQSDALYQYILETTVYPREHECMKQLREDTANHPWNLMTTSADEGQFLNLLIKLIGAKKTMEIGVYTGYSLLATALAIPEDGTILAMDINRENYETIGKPCIEKAGVAHKIDFREGPALPVLDELLEDEANHGSFDFVFVDADKDNYLNYHQRLMKLVRVGGLIGYDNTLWNGSVVLPADAPMRKYIRYYRDFVLELNKALAADDRVEICQLPVGDGITLCRRAK

SEQ ID NO: 100 - protein, 363 aa, Lolium perenne
MTVVEVLAAGDAAAAAVARPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMHPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDEANPRKQPYKMSNQKLQDLGLEFRPVSQSLYETVKSLQEKGHLPVLSEQAEADKETLAAELQAGVTIRA

SEQ ID NO: 101 - protein, 342 aa, Festuca arundinacea
MTVVDAAAPQLPGHGQTVCVTGAAGYIASGLVKLLLERGYTVKGTVRNPDDPKNAHLKALDGATERLILCKADLLDYDAICAAVEGCHGVFHTASPVTDDPEQMVEPAVRGTEYVINAAADAGTVRRVVFTSSIGAITMDPNRGPDVVVNESCWSDLEFCKKTKNWYCYGKAVAEQAAWEAARKRGIDLVVVNPVLVVGPLLQPTVNASAAHILKYLDGSAKKYANAVQSYVDVRDVAGAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKPEGLNGVTA

SEQ ID NO: 102 - protein, 360 aa, Festuca arundinacea
MGSTAADMAASADQEACMFALQLASSSILPMTLKNAIELGLLEILVAAGGKSLTPTEVAAKLPSAANPEAPDMVDRMLRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 103 - protein, 360 aa, FLolium perenne
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVECILPVNPEANPSSQGVFHVDMIMLAHNPGGRERYEREFQALARGAGFTGVKSTYIYANAWAIEFTK

SEQ ID NO: 104 - protein, 360 aa, Festuca arundinacea
MGSTAADMTASADEEACMFALQLASSSILPMTLKNAIELGLLEILVAAGGKSLTPTEVAAKLPSAANPEAPDMVDRMLRLLASYNVVSCLVEEGKDGRLSRNYGAAPVCKFLTPNEDGVSMAALALMNQDKVLMESWYYLKDAVLDGGIPFNKAYGMSAFEYHGTDPRFNRVFNEGMKNHSIIITKKLLELYDGFQGLGTLVDVGGGVGATVAAITAHYPAIKGVNFDLPHVISEAPPFPGVTHVGGDMFKKVPSGDAIMMKWILHDWSDQHCATLLKNCYDALPAHGKVVLVECILPVNPEAKPSSQGVFHVDMIMLAHNPGGRERYEREFEALARGAGFAGVKSTYIYANAWAIEFTK

SEQ ID NO: 105 - protein, 361 aa, Lolium perenne
MGSTAAEIAASADEEACLYALQLGSSSILPMTLKNTIELGLLETLMAAGGKSLTPTEVAAKLPCAAKNPEAPDMVDRMLRLLASYNLVSCLVEEGTDGRLSRRYGAAPVCKFLTPNEDGVSMAALALMNQDKVLMESWYYLKDAVLDGGIPFNKAYGMSAFEYHGTDLRFNRVFNEAMKNNSIIITKKLLQLYDGFQGLGTLVDVGGGVGATVAAITAHYPTIKGINFDLPHVISEAPPFPGVTHIGGDMFKKVPSGDAILMKWILHDWSDQHCATLLKNCYDALPVHGKVVLVECILPVNPEAKPSSQGVFHVDMIMLAHNPGGRERYEREYEALARGAGFAGFKSTYIYANAWAIEFTK

SEQ ID NO: 106 - protein, 532 aa, Lolium perenne
MVGFAKIAMEWIQDPLSWLFIASVVFVVLQRRRRGNVAPFPPGPKPLPIVGNMSMMDQLTHRGLAALAKEYGGLLHIRLGKLHTFAVSTPEYAREVLQVQDGAFSNRPATIAIAYLTYDRADMAFAHYGPFWRQMRKLCVMKLFSRRRPETWLAVRDESAALVRAVARRTGESVDLGELIFKLTKNVIFRAAFGAGAVAADAEEGDGAGKQDEFIAILQEFSKLFGAFNIGDFIPWLSWADPQGINVRLRAARNALDEFIDKIIDEHMERGKNPDDADADMVDDMLAFLPEAKPKKGAAGDGVDDLQNTLRLTRDNIKAIIMDVMFGGTETVASAIEWAMAEMMHSPDDLRRLQQELVDVVGLDRNVDESDLDKLPFLKCVIKETLRLHPPIPLLLHETAEDCVVGGYSVPRGSRVMINVYAIGRDRRAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQ

SEQ ID NO: 107 - protein, 542 aa, Festuca arundinacea
MVGFAKIAMEWLQEPLSWLFIASVVFVVLQRRRRGNVAPFPPGPKPLPIVGNMSMMDQLTHRGLAALAKEYGGLLHIRLGKLHAFAVSTPEYAREVLQVQDGAFSNRPATIAIAYLTYDRADMAFAHYGPFWRQMRKLCVMKLFSRRRPETWLAVRDESAALVRAVARRSGESVDLGELIFKLTKNVIFRAAFGAGAVAGDGDGDGAGKQDEFIAILQEFSKLFGAFNIGDFIPWLSWADPQGINVRLRAARAALDEFIDKIIDEHMERGKNPDDADADMVDDMLAFLPETKPKKGAAGDGVDDLQNTLRLTRDNIKAIIMDVMFGGTETVASAIEWAMAEMMHSPGDLRRLQQELADVVGLDRNVDESDLDKLPFLKCVIKETLRLHPPIPLLLHETAEDCIVGGYSVPRGSRVMINVYAIGRDRKAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQLLGADDAGRQA

SEQ ID NO: 108 - protein, 711 aa, Lolium perenne
MESENVAANGDGLCVAQPARADPLNWGKAAEELSGSHLDAVKRMVEEYRRPVVTMEGASLTIAMVAAVAAGADTRVELDESARGRVKESSDWVMNSMANGTDSYGVTTGFGATSHRRTKEGGALQRELIRFLNAGAFGTGSDGHVLPAATTRAAMLVRVNTLLQGYSGIRFEILETVATLLNANVTPCLPLRGTITASGDLVPLSYIAGLVTGRPNSVATAPDGTKVNAAEAFKIAGIQHGFFELQPKEGLAMVNGTAVGSGLASMVLFEANILGILAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISARKTSEAIDILKLMSSTFLVALCQAIDLRHLEENVKNAVKNCVKMVARKTLSTNDSGHLHSARFCEKDLLLTIDREAVFAYADDPCSANYPLMQKMRAVLVEHALANGEAERDVQTSVFAKLAAFEQELRAVLPREVESARCAVENGTAAQQNRITECRSYPLYRFVRKELGTEYLTGEKTRSPGEEVDKVFVAMNQGKHIDALLECLKEWNGEPLPIC

SEQ ID NO: 109 - protein, 713 aa, Festuca arundinacea
MECENGHVAANGDGLCVAQPARADPLNWGKAAEELSGSHLDAVKRMVEEYRRPVVTMEGASLTIAMVAAVAAGADTRVELDESARGRVKESSDWVMNSMANGTDSYGVTTGFGATSHRRTKEGGALQRELIRFLNAGAFGTGSDGHVLPAATTRAAMLVRVNTLLQGYSGIRFEILETIATLLNANVTPCLPYRGTITASGDLVPLSYIAGLVTGRPNSVATAPDGSKVNAAEAFKIAGIQHGFFELQPKEGLAMVNGTAVGSGLASIVLFEANILGILAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFMVALCQAIDLRHIEENVKNAVKNCVKTVARKTLSTNDSGHLHNARFCEKDLLLTIDREAVFAYADDPCSANYPLMQKMRAVLVEHALANGEAEQDVQTSVFAKLATFEQELRAVLPKEVESARCSVENGTAAQQNRISECRSYPLYRFVRKELGTEYLTGEKTRSPGEEVDKVFVAMNQGKHIDALLECLKEWNGEPLPIC

SEQ ID NO: 110 - protein, 323 aa, Festuca arundinacea
MAFSGSVSGVVLVVAILLLGLAAAASAQLSATFYDASCPSALATIKSAVTAAVNNEARMGASLLRLHFHDCFVQGCDASVLLNDTANFTGEQTAFPNRNSIRGLNVIDNVKAQVEAVCTQTVSCADILAVAARDSIVALGGPSYTVPLGRRDSTTASLSEANRDLPPPSSDLADLVGNFSRKGLSVTDMVALSGAHTIGRAACLNFRSRIYGESNIAPAYAASLQANCPQSAPNGDGTLAPLDVSTPDAFDNAYYGNLLSQQGLLHSDQQLFNGGSTDSLVSTYASNAAQFSGDFAAAMVNMGNIGVLTGAQGEIRLNCGKVN

SEQ ID NO: 111 - protein, 344 aa, Lolium perenne
MASSSSPFSRVSQLAVKATVLAAVCLLLHGGGGSSASAAELCVSYYDHTCPDAYKIVQGVLVEAHKSDPRIFASLIRLHFHDCFVLGCDGSLLLDTFPGFQSEKDARPNNNSARGYPVVDAAKAALEKACPGVVSCADILALAAEISVQLSGGPGWGVLLGRLDGKTSSIAGAQNLPGPFDGLKNLTLKFQAVNLDVTDLVALSGAHTFGRVKCRFVTNRLYNFSGTNQPDPTLNAAYRAFLSTRCPRNGDANSLNDLDPTTPDTFDKNYFTNLEKNRGFLDSDQQLKSDPGALTTTAPIVDRFASSQDAFFKSFAWSMIKMGNILPITDPSRGEVRKHCAFVN

SEQ ID NO: 112 - protein, 326 aa, Festuca arundinacea
MATRGVMVALLLAAVAASCAHAQLHEKFYSESCPSVEDVVRKEMVMALSLAPSLAAPLLRMHFHDCFVRGCDGSVLLDSANKTAEKDALPNQTLRGFDFVERVKAAVEKACPDTVSCADVVTLIARDAVWLSKGPFWEVPLGRRDGSVSISNETDALPPPTANITVLTQLFAAKNLDIKDLVVLSAAHTIGTSHCFSFSDRLYNFTGLDNASDIDPTLEPFYMAKLKSKCTSLDDNSTLVEMDPGSFKTFDLDYFKLVSKRRGLFHSDGALLTDAFTRAYILRHATGAFKDEFFADFAVSMVKMGNTDVLTGSQGEIRKKCSVVNH

SEQ ID NO: 113 - protein, 358 aa, Lolium perenne
MASSRVLLLVVAALAISVSATAAATKISAPLPPLAKGLNFDFYKATCPQAESIVFNFLRDAIRKDVGLAAALLRIHFHDCFVQGCDGSVLLDKTGGTDSEKIAPPNVTLRPTAFKAINDLRALLAKACGAVVSCADIAALAARDSVHLAGGPHYPVPLGRRDGLAPANLTTILNALPAPSSNVTTLLRFLAKISLDANDLVALSGAHTLGIAHCTSFQERLFPQNDVTLNKWFASQLRLTCPALNTDNTTNNDIRTPNVFDNKYYVDLLNRQGLFTSDQDLHTDARTKPTVTRFAVDQAAFFDQFVFSVVKMGQINVLTGSQGQIRNDCSAPNKGRTNDDLPWSVLETVTEAAQSLVL

SEQ ID NO: 114 - protein, 344 aa, Lolium perenne
MTTMGGSSILPAPTVATTALVLLIVLFASPATVAKGSGLSVGFYKKLCPKAEKVVRRTVTKAFEKEPGTPADIIRLFFHDCFVRGCDASVLLESTPGRMAERDSKANNPSLDGFEVISDAKETLEKLCPQTVSCADILALAARDGAYLASGLDYAVPTGRRDGLVSKEDEVLPSVPHPDFNHSQLVENFTAKGFTAEEMVTLSGAHTIGTSHCSSFTDRLYNFSQGGALTTDPALPAAYAALLKEKCPPETAAQNDTTMVQLDDVTPFVMDNQYYKNLLAGTVPLGSDVALMESPDTAALVELYAREPAEYWAKRFVAAMVKVSEMEVLTGAEGEIRLNCSKVN

SEQ ID NO: 115 - protein, 293 aa, Lolium perenne
TRENYYGSSCPTALLTIRTVVTTAVLLDHRMGASLLRLHFHDCFVQGCDASVLLDDTAGFTGEKGAGPNAGSLRGLEVIDKIKMLLEFMCPRTVSCADILAVAARDSVVRLGGPSWAVQLGRRDATTASASLASSDLPGPNSNLNDLLTAFSKKGLSTTDMVALSGAHTIGRAQCQNYRNRIYTDTDIDGAFAASLRGGCPQAGGDGNLAPLDASSPNTFDNGYFSGLLSRQGLLHSDQALYDGGSTDDLVRTYASNNDQFGSDFAAAMVKLSNIGLLTGSSGEIRVNCRAVN

SEQ ID NO: 116 - protein, 311 aa, Festuca arundinacea
MASASCISLVLLVALAATAASAQLSSTFYDTSCPRALATIKSGVAAAVSSNPRMGASLLRLHFHDCFVNGCDASVLLSGNEQNAPANAGSLFGFGVIDNIKTQLEGICKQTVSCADILTVAARDSVVALGGPSWTVPLGRRDSTSATGNTGDLPGPGSSLAQLQAAFAKKNLNTVDMVALSGAHTIGRAQCQNFRSRIYGGDSNINAAFATSLKANCPQSGGNGNLAALDATTANAFDNAYYTNLLSQKGLLHSDQVLFNNGSTDNTVRNFASSGAAFSSAFATAMIKMGNISPLTGTQGQIRLSCSKVNS

SEQ ID NO: 117 - protein, 230 aa, Lolium perenne
MAVSELEVDGVVFPPLARPPGTAHAHFLAGAGVRGMELGGNFIKFTAIGVYLQADAAVSALATKWAGKPADELAADNAFFRDVVTGEFEKFTPVTMILPLTGAQYSEKVTENCVAYWKAVGKYTNAEAAAVDKFKEAFRTESFPPGASILFTHSPAGVLTVAFSKDSSVPESGGVAIENRPLCEAVLESIIGEHGVSPAAKLSLATRVAELLNEAAPVGQAAAEPVSVSA

SEQ ID NO: 118 - protein, 231 aa, Festuca arundinacea
MAVSELEVDGVVFPPLARPPGTAHAHFLAGAGVRGMELGGNFIKFTAIGVYLQADAAVSALAAKWAGKPADELAADNAFFRDVVTGEFEKFRRVTMILPLTGAQYSEKVTENCVAYWKAVGKYTDAEAAAVDKFKEAFKAESFPPGASILFTHSPAGVLTVAFSKDSSLPESGGVAIENRPLCEAVLKSIIGKHGVSPAAKLSLATRVAELLKEAAPVGEPAVAEPVSVSA

SEQ ID NO: 119 - protein, 394 aa, Lolium perenne
MAATMTVEEVRKAQRAEGPATVLAIGTATPANCVYQADYPDYYFKITKSDHLADLKEKFKRMCDKSQIRKRYMHLTEEILEENPNMCAYMAPSLDARQDIVVVEVPKLGKAAAQKAIKEWGQPRSKITHLVFCTTSGVDMPGADYQLTKMLGLRPSVKRLMMYQQGCFAGGTVLRLAKDLAENNRGARVLVVCSEITAVTFRGPHESHLDSLVGQALFGDGAAAVIIGADPDVSVERPLFQLVSASQTILPDSEGAIDGHLREVGLTFHLLKDVPGLISKNIERALEEAFKPLGIDDWNSVFWVAHPGGPAILDMVEAKVNLNKERMRATRHVLSEYGNMSSACVLFIMDEMRKRSAEDGHTTTGEGMDWGVLFGFGPGLTVETVVLHSMPIAA

SEQ ID NO: 120 - protein, 196 aa, Festuca arundinacea
MYFVSKSLAENAAMDYAKENGVDFISIIPTLVVGPFLSAGMPPSLVTALALITGNEAHYSILKQVQLVHLDDLCDSMTYLFEHPDANGRYICSSHDTTIHGIARMLKERFPEYDIPQKFPGADDDLQPIHFFFKKLLDHGFRFRYTAEDMFDAAVWTCREKGLIPLGAEGAGGPASAAGKLGAVLVGEGQAIGAET

SEQ ID NO: 121 - protein, 329 aa, Lolium perenne
MATEAKGETVLVTGASGFIGSWLVRLLLARGYSVHAAVLNPDDKAETDHLLALAAAAGDEGRIRFFRCDLLDGAAMLAAVRGCSGVFHLASPCTVNLVLNPQKELVVPAVEGTLNVLRAAKEAGGVRRVVVTSSVSALVPCPGWPAGEVLDERCWTDIDYCDKNGVWYPASKALAEKAAWKFAEENGLDVVTVNPGTVLGEMIPPRLNASMAMFLRLLEGCKEEYADFFIGPVHVEDVALAHILLYENPSASGRHLCVEPICHWSVFAAKVAELYPDYKVPKFPEDTQPGLVRAKAVPKKLMALGLQFTPLEKIIRDAVESLKSRGCIA

SEQ ID NO: 122 - protein, 328 aa, Lolium perenne
GSTKGKVCVTGASGFVASWLIKKLLESGYHVIGTVRDPGNRRKVGHLWKLPGANERLQLVRADLLEEGSFDDAVRACEGVFHIASPVLGKSDSNCKEATLGPAINGTLNVLRSCKKSPFLKRVVLTSSSSAVRIRDETQQPELLWDETTWSSVPLCEKLQLWYALAKVFAEKAALDFAKENNIDLVTVLPSFVIGPSLSHELCTTASDILGLLQGDTDRFTLYGRMGYVHIDDVARSHILVYETPEATGRYLCSSVVLDNNELVGLLAKQFPVFPIPRRLKNPYGKQAYQLDTSKLQGLGLKFKGVQEMFNDCVESLKDQGHLLECPL

SEQ ID NO: 123 - protein, 369 aa, Lolium perenne
MAPVVERAPFLPTGEATLRPSFVRDEDERPKVAHDRFSDEVPVISLHGIDDARRTEIRDRVAAACEGWGIFQVVDHGVDAALIAEMARLSRDFFALPAEDKLRYDMSGGKKGGFIVSSHLQGETVQDWREIVTYFSYPVKARDYGRWPDKPAGWRAVVEQYSERLMALSCKLLGVLSEAMGLETEALSKACVDMDQKVVVNFYPKCPQPDLTLGLKRHTDPGTITLLLQDLVGGLQATRDGGNTWITVQPIAGAFVVNLGDHGHYLSNGRFKNADHQAVVNGESSRLSIATFQNPAPDAKVWPLAVREGEDTILEEPITFTEMYRRKMARDLELAKRKKQAKADQLKQQLQQEAAPAAAPTKPLNQILA

SEQ ID NO: 124 - protein, 380 aa, Festuca arundinacea
MASVENAPFLPTAATGEATLRPSFVRDEDERPKVAHDRFSDEVPVISLHGIDDGGARRAEIRDRVAAACEGWGVFQVVDHGVDAALVAEMARLSREFFALPAEDKLRYDMSGGKKGGFIVSSHLQGETVQDWREIVTYFSYPVKARDYGRWPEKPAGWRAVVEQYSERLMALSCKLLGVLSEAMGLETEALSKACVDMDQKVVVNFYPKCPQPDLTLGLKRHTDPGTITLLLQDLVGGLQATRDGGNTWITVQPVPGAFVVNLGDHGHYLSNGRFKNADHQAVVNGESSRLSIATFQNPAPEAKVWPLAVREGEDTILEEPITFTEMYRRKMACDLELAKRKKQAKADQLKQQLQQEQQEAVAAAAPKPATTKPLNQILA

SEQ ID NO: 125 - DNA, 2105 bp, Lolium perenne
acttagccttcctcggaaccatcgaccgggccgccgccgacgcgacgcgacgcgatggagtccagcgccgtcgtccccggcaccacggcgccgctgcttccttatgcgtacgcgccgctgccgtcgtcctccgacgacgcccgtgaaaacagaagtagcggcggcgtgaggtggcgcgcgtgcgccgccgttctggcggcctcggcgttggcggtggtggtcgtggtcgggctcctcgcgggcggcagggtggatcgggtcccggccggcgcagacgtggcgtcggccacggtgccggccgtgccgatggagttcccgaggagccggggcaaggacttgggcgtgtcggagaagtcctccggtgcctactccgccgacggcgggttcccgtggagcaacgccatgctgcagtggcagcgcaccgggttccatttccagccggagcagcactacatgaacgatcccaacggccccgtgtactacggcggatggtaccacctcttctaccagcacaaccccaagggcgacagctggggcaacatcgcctgggcccacgccgtgtccaaggacatggtcaactggcgccacctcccgctcgccatggttcccgaccagtggtacgacagcaacggcgtcctcaccggctccatcaccgtgctccccgacggccaggtcatcctgctctacaccggcaacaccgacaccctagcccaggtccagtgcctcgccacgcccgccgacccgtccgacccgctcctccgcgaatggatcaagcaccccgccaaccccatcctcttcccgccgcccgggatcgggctcaaggacttccgcgacccgctcaccgcctggttcgaccactccgaccacacctggcgcaccgtcatcgggtccaaggacgacgacggccacgccggcatcatcctcagctacaagaccaaggacttcgtcaactacgagctcatgcccgggaacatgcaccgcgggcccgacggcaccggcatgtacgagtgcatcgacctctaccccgtcggcggcaactcgtcggagatgctcggcggcgacgactcgcccgacgtgctcttcgtgctcaaggagagcagcgatgacgaacgtcacgactactatgcgctcggaaggttcgacgccgtcgccaacgtttggacgcccatcgaccgggacctggaccttgggatcgggctcagatacgactggggaaagtactacgcctccaagtccttctacgaccagaagaagaaccgccgcatcgtatgggcatacatcggcgagaccgactccgagcaggccgacatcaccaagggatgggccaatctcatgacgattccaagaacggtggagcttgacaggaagacccgcacaaacctcatccaatggccagtggaggaggtcgacaccctccgcaggaactccacggacctcggtcgcatcaccgtcaacgccggctccgtcattcgcctccccctccaccagggcgctcaactcgacatcgaggcctccttccaactcaactcttccgacgtggatgctatcaacgaggccgacgtcggctacaactgcagcaccagcggtgccgccgtacggggggcgctcggcccctttggcctcctcgtccttgccaatggccgcaccgaacagacggctgtgtacttctacgtgtccaagggcgtcgacggcggcctccagacccacttttgccacgacgagtcacggtcaacacgggcaaaggatgtcgtgaataggatgattggcagcatcgtgccggtgcttgacggtgagaccttttcggtgagggtgctagtggaccactccatcgtgcagagcttcgcgatgggcgggaggatcacggcgacgtcgcgggcgtacccgacggaggccatctacgcggccgcaggggtctacctcttcaacaacgccacgggcgccaccgtcaccgccgagaggctcgtcgtgcacgagatggcctcagctgacaaccatatcttcacgaacgacgacttgtagatgaaaccaagtttagctcgtgttgcattcttgttaacggccggtgattgcctatctacacattcatttggcgttcaaaaaaaaaa

SEQ ID NO: 126 - DNA, 2068 bp, Festuca arundinacea
cccatccaccggagtatactaggaaattcctgcaactcgacctcgcgttgggaattccggcaatggagtcccgggcctttcccaacgcggcgtacgcgccacttctgccacccaccgctgacgacgccaccctgggcaagcaggaccgccccggcgtggggtggcgcgggttcttaaccgtgctggccgcgtctggcgtggtggtgctcctcgtcgctgccactatgctcgcgggatccaggatgggtcaggcaggcgacaccgacgaggacggggccggagggttcccgtggagcaacgagatgctgcagtggcagcgcgccgggttccattaccagcccgaggggcacttcatgagcgatccagacggtccggtatactaccgtggatattaccacctcttctttcagtacaaccgaaggggcgtcgcgtgggatgactacatagagtggggccacgtggtgtcccaggacctggtacactggcgccctctcccactggccctgcggcctgaccattggtacgacaagaagggcgtcttgtcgggtaccatcacggtgctccacaatggcacgctcgtcctgctctacacgggggtcacagaagaccctatggccgagtctcagtgcatcgccgtcccgaccgaccccaacgaccccctccttcgccattggaccaagcaccccgccaaccctgttctcgctcacccacagggggtccagggcatggacttccgagaccccaccagtgcatggtttgacaagtccgacgccacgtggcgcattctcatcggttccaaggatgacgacaatggaagccacgctggcatcgccttcatcttcaagaccaaggacttccttagcttcgagcgcgtcccaggtatcgtgcatcgtgtcgagggtaccggtatgtgggagtgcatcgacttttaccccgtcggaggtggccacaactcttcgtcggaggagctgtacgtgataaaggcgagcatggacgacgaacgacacgactactactcattggggagatatgacgcggcagccaacacatggacgccattggacgccgagctagacttggggattgggctgagatacgactggggcaagctctacgctgccacgtcgttctacgatccgctgaagcagcggcgaattatgttggggtatgtaggcgagaccgactctgcacgagccgacgttgccaagggatgggcctcacttcagtcgattccgaggacagtgacactagacgagaagaccaggacgaacctcctcctatggccggtggaggaggtggaggccctccgctacaactccaccgacctcagtggcatcactgttgacaacggctcagtcttccacctccccctccaccaagccactcagctggacatcgaggcttccttccgcctcgacgcttctgacgttgccgccatcaacgaggccgatgtcggctataactgcagcagcagcggtggcgcggccgcacgtggcgctatcggccccttcggcctcctcgtccatgccgccggagacctccgtggcgagcagacggcggtgtacttctacgtgtccagggccctcgacggtaccctccggactagcttctgcaacgacgagacgcggtcgtcacgggccagggacgtgacgaagcgggtggtgggcagcacggtgccggtgctccacggtgaggcgttgtcgatgagggtgctcgtggaccactccatcgtgcagagcttcgccatgggtgggagagtcacggcgacctcgcgggtgtacccaacggaggccatctacgccagggcaggggtgtacctgttcaacaacgctaccggcgccagcgtgactgcggagaggctcatcgtgcacgagatggcctcggcggtatacgacgagaccctgatcatggttgaggactcgtagctgctcacatgagctatatatcagaccggtaacgttgggtcacttgcatttccaagcgttgaataatttacttagcttagcaagcaacaggtccgaggttccaagtaaggtgtgggatattcttccaaaattcaaaaaaaaaa

SEQ ID NO: 127 - DNA, 2198 bp, Lolium perenne
cacccatccaccggaatatatatactagccaggaaattcctgcaactcgacctcgagttgggaattccggcaatggagtcccgggcctttcccagcgcggcgtacgcgccacttctgccatccgccgcagacgacgtcgccctggccaagcaggaccgccccggcgtggggtggcgcgggttcttaaccgtgctggccgcctgcggcgtggtggtgctcctcgtcggtgccactttgctcgcgggatccaggatgggtcaggcaggcgacggcgaaggcaacaccgacgaggatggggccggagggttcccgtggagcaacgagatgctgcagtggcagcgcgccgggttccattaccagccggaggggcacttcatgagcgatccaaacggtccagtatactaccgcggatattaccacctcttctttcagtacaaccgaaggggcgtcgcgtgggatgactacatagagtggggccacgtggtgtcccaggacctggtacactggcgccctctcccactggccatgcggcctgaccattggtacgacaagaagggcgtcttgtcgggtaccatcacggtgctccacaatggcacgctcgtcctgctctacacgggggtcacagaagaccctatggccgagtcccagtgcatcgccgtcccgaccgaccccaacgaccccctccttcgccattggaccaagcaccccgccaaccccgtcctcgctcacccacagggggtccagggcatggacttccgagaccccaccagcgcgtggtgggacaagtccgatgccacgtggcgcattctcatcggttccaaggacgacgacaacggcagccacgctggcatcgccttcatcttcaagactaaggacttccttagcttcgagcgtgtcccaggtatcgtgcatcgtgtcgagggcaccggcatgtgggagtgcatcgacttttaccccgtcggaggtggccacaactcttcgtcggaggagttgtacgtgataaaggcgagcatggacgacgaacgccacgactactactcattggggaggtacgacgcggcagcgaacacatggacgccattggacgccgagctagacttggggattgggctgagatacgactggggcaagctctacgcttccacgtcgttctacgatccggtgaagcagcggcgcattatgttggggtatgtaggcgaggtcgactctgcgcgagccgatgttgccaagggatgggcctcgcttcagtcgattccgaggacagtggcgctagacgagaagacccgaacgaacctcctcctatggccggtggaggaggtggaggccctccgctacaactccaccgacctcagcggcatcaccattgacaacggctccgtcttccacctcccactccaccagaccactcagctggacatcgaggcttccttccgcctcgacgcttctgatgttgccgccatcaacgaggccgacgtcggctacaactgcagcagcagcggcggcgcggcggcacgtggcgctctcggccccttcggcctcctcgtccatgccgccggagacctccgtggcgagcagacggcggtctacttctacgtgtccagggccctcgacggtaccctccggaccagcttctgcaacgacgagacgcggtcgtcgcgggccagggacgtgacgaagcgggtggtgggcagcacggtgccggtgctcgacggcgaggcgttgtcgatgagagtgctcgtggaccactccatcgtgcagagcttcgcgatgggcgggaggaccacggcgacctcgcgcgtgtacccgacggaggccatctacgccagggctggggtgtacctgttcaacaacgccaccggcgccggcgtgacggcggagaggctcatcgtgcacgagatggcctcggcggtatacgacgagaccctcatggttgaggactcatagctgctcacccgtaacgttgggtcacttgcatttccaagcgttgaattaataatttacttgttgtagcagcaagcaacggtccgaggttccaagtaaggtgggatattctaccaaactccgcgagtcccgcaaggttgtgtaggtgtgagttgatgttggcgcacctgcgcgtgtgcatgtaagttgttgtatttgttgttcttttaaaaaagaaagataccaatctaccatactatgtaagcataaaaaaaaaa

SEQ ID NO: 128 - DNA, 2208 bp, Lolium perenne
cacccatccaccggagtatactagctaggaaattcctgtgcaactcgacctcgagtttggaattccggcaatggagtcccgggactttcccagcgcggcgtacgcgccacttctgccatctgccgcagacgacgtcgccctggccaagcaggaccgccccggcgtggggtggcgcggcttcttaaccgtgctggccgcctgcggcgtggtggtgctcctcgtcgctgcctctttgctcgcggggtccaggatgggtcaggcaggcgacaccgacgaggacggggccggagggttcccgtggagcaacgagatgctgcagtggcagcgcgccgggttccattaccagccggaggggcacttcatgagcgatccagacggtccggtatactaccgtggatattaccacctcttctttcagtacaaccgaagaggggtcgcgtgggatgactacatagagtggggccacgtggtgtcccaggacctggtacactggcgccctctcccactggccatgcggcctgaccattggtacgacaagaagggcgtcttgtcgggtaccatcacggtgctccacaatggcacgctcgtcctcctctacacgggggtcacagaagaccctatggccgagtcccagtgcatcgccgtcccgaccgaccccaacgaccccctccttcgccattggaccaagcaccccgccaaccccgttctcgctcacccacagggggtccagggcatggacttccgagaccccaccagcgcgtggtgggacaagtccgactccacgtggcgcattctcatcggttccaaggacgacgacaacggcagccacgctggcatcgccttcatcttcaagaccaaggacttccttagcttcgagcgtgtcccaggtatcgtgcatcgtgtcgagggtaccggcatgtgggagtgcatcgacttttaccccgttggaggtggccacaactcttcgtcggaggagttgtacgtgataaaggcgagcatggacgacgaacgacacgactactactcattggggaggtatgacgcggcagcgaacacatggacgccattggacgccgagctagacttggggattgggctgaggtacgactggggcaagctctacgcttccacgtcgttctacgatccactgaagcagcggcgaattatgttggggtatgtaggcgaggtcgactctgcgcgagccgacgttgccaagggatgggcctcacttcagtcgattccgaggacagtggcactagacgagaagacccggacgaacctcctcctatggccggtggaggaggtggaggccctccgctacaactccaccgacctcagcggcatcactgttgagaacggctccatcttccacctccctctccaccaagccactcagctggacatcgaggcttccttccgcctcgatgcttctgatgttgctgccatcaacgaggccgacgtcggctacaactgcagcagcagcggtggcgcggccgctcgtggcgctctcgggcccttcggcctcctcgtccatgccgccggagacctccgtggcgagcagacggcggtgtacttctacgtgtccagggccctcgacggtagcctccggaccagcttctgcaacgacgagacgcggtcgtcacgggcccgggacgtgacgaagcgggtggtgggcagcacggtgccggtgctcgacggcgaggtgttagcgatgagggtgctcgtggaccactcgatcgtgcagagcttcgcgatgggtgggagggtcacggcgacgtcgcgggtgtacccaacggaggctatctacgccagggcaggggtgtacctgttcaacaacgccaccggcgccagcgtgacggcggagaggctcatcgtgcacgagatggcctcggcggtatacgacgagaccgtcatggttaaggactcatagctgctcacacatgagctatcagaccggtaacgttgggtcactagcattttcaagcgttgaaataatttacttggcgtagcaagccccgggtccgaggttccaaaagtaaggtgggatattcttccaaactccgcgagtcccgcaaggttgtctaggtgtgagtgtgatgtcgtttgcgcacctgcgcgtgtgcttgtaatttgctggatttgttgtttctttacagaaaaaaaaggatactatactatgtaagtatctacattgttgtaaaaaaaaaa

SEQ ID NO: 129 - DNA, 1790 bp, Festuca arundinacea
caccaacgaaattcgggaggaagaaaggcgctcgcccatctctcccgaaacaaccgctcgccacccgtctccctcccctgccctcgcctccccattccccttcctcttcttcccttggcgacggcctcgtcgatcggacccaatctccaccaaacgcgcctccggatctcgcgcgccgcctcgaaggggatcctcccgtggccgccgtcctcctccgccgctcggctggactgtcgtggagcggggatcgacccgggctctctgtcgctggttgctaaaatggataagctcaatggttctgcgcgtcttatgattgtttcagacctcgatcatacaatggttgatcatcatgacgaagagaacttgtcgttgcttaggtttggggccctttgggagtctgcttactgtcaggattctctacttgtcttctcgaccggaagatcacccactctctataaggaattgaggaaagagaagcctatgctaactccagacatcactattatgtcggtgggcagtgagataacttatggtgaggccatggttcctgatgatggctgggaggaatatctgaacaataagtgggacagaaatattgttcttgaggagaccgctaagtattctgagctgaagcttcagccagagacagaacagcgtccacataaggtcagcttcttggttgacaagaagagtgctcaggaagtgataaagtctctctctgagaagtttgagaaacgtggggtagatgcaaaaataatctatagtggtggccaagaccttgacatattagctcaaggggctggaaagggtcaggcgcttgcatatttactcaagaagttcgcctcatgcgggaaaacacccaacaatactcttgtttgtggtgactctggcaatgatgcagaattattcagcatccctggtgtgcacggtgtcatggttagcaatgcccaagaggaactactccagtggcatgcagaaaatgcgaaggataaccctaaggtaattcatgcaactgagaggtgtgctgctggtattattcaagctattgggcacttcaagctaggacctaatatttctccaagagacattgagtttccttacgtcaaggaggactctttcaagcctacagcggctgttgtgaagttctatgttctctgcgagaagtggcgtagggctgacgttccaaaggctgattcagttatagagtacttcaaaaacatcacggatgcaagtggagttattattcatccctctggcctcgaactttcgatccattcttccatcgatgcgttggcttcatgttatggtgacaaacaagggaaaaagtaccgatcatgggtggacagactagttatctcacagactgcttctgacagttggcttgtgagatttgacttgtgggaggcagaaggtgatgcatgggtgtgctgtttgacaactcttgcgctgaatgtaaagcctgaaacccctgggggtttcgtggtaacacacatccacaagacatggctcaaagaatattccggggatgagcaggcgtccaaactctagactggatctctaccgtcagcgcacgggaaggaaattttcttgagaatcaaataagaagcgcacagaaaacacgagaatttcttttccttgttcataatgttaataagtgctcccagacactacatatatcatactggatgaagtatacggaggtcttgatgcttggcctaatgcttacttgatgtgtaagataaaaatattatatctcgttactggcatgagaagctgaagtaaaaaaaaaa

SEQ ID NO: 130 - DNA, 3633 bp, Festuca arundinacea
gcagagtagcctgcctgctcgccggcgagagatagctagggagggagggtaactagcgcaggaggagcctgctcgcctgccgtcgagatggcggcggggaacgagtggatcaacgggtacctggaggcgatcctggacgccgggtcgaagctgcggccgcagggcgtgcagctgccgccgctggagacggcgccggcgctcgcggccgaggagtccggcgccgcctacaaccccaccaggtacttcgtggaggaggtggtcaggagcttcgacgagcaggccctccacaagacatggacaaaggtggttgcgatgcggaacagccaggagcgcagcaaccggctggagaacctgtgctggaggatctggaacgtctccaggcagaagaagcaggtggagtgggattacacgaaagaggtggcccggcggaagcttgagcaggagctgggcagccgggaggccgccgaggacctctccgagctctccgagggcgagaaggataccaccaccgccaagcctgacgccgcaaccgctcaaccgtccaccgacgatggcgagcaccagcagccacaaccacgcacccggctcgcgaggatcaactccgaggtgcggctcgtctccgacgacgaggaggagcagaccaagaagaggaacctctacatcgtcctcatcagcatccatgggctggtgcgcggggagaacatggagctcggccgagactccgacaccggaggccaggtgaagtacgtggtggagctggcccgtgcgctggcggccacggcgggggtgcaccgcgtggacctgctgacgcggcagatctcctgccccgacgtggactggacctacggcgagccggtggagatgctggagcgcctgtcgtcggcggacgcggacgaggacgacggcgagcagtctggcggcggggcgtacatcgtgcggctgccgtgcgggcccagggaccagtacatccccaaggaggagctgtggccgcacatcccggagttcgtggaccgcgcgctctcgcacgtcaccgaggtggcgcgcgcgctaggcgaccagctccagcctcctcccactccggccgcgggcgacggcgcagccctagtggcagcgcccatatggccgtacgtgatccacggccactacgcggacgcggcggaggtggcggcgaacctggcgagcgcgctgaacgtgcccatggtcatgacgggccactcgctggggcgcaacaagctggagcagctgctcaagctgggccgcatgccgggccccgagatccagggcacctacaagatcgcgcgccggatcgaggccgaggagaccggcctcgacaccgcggagatggtggtcaccagcaccaagcaggagatcgaggagcagtggggcctctacgacggcttcgacctcatggtggagcgcaagctcagggtaaggcagcgccgcggcgtcagcagcctcggcaggtacatgccgcgcatggcggtcatcccgcccggcatggacttcagcttcgtcgagacacaggacacggctgagggggatggcgccgacctgcagatgctcattgcccccgacaaggccaagaaggctctgcctcccatttggtcggacgtgctgaggttcttcacgaacccgcacaagccgatgatcctggcgctgtcgcggccggacccgaagaagaacgtcactacgctgctcaaggcctacggcgagagccgccagctccgggagctcgcgaacctgactttgatactggggaacagggatgacatcgaggacatggccggcggcggcggcgcggtgctcacggcggtgctcaagctcatcgaccgatacgacctctacggccaggtggcctatccaaagcaccacaagcagacggacgtgcctcacatctaccgcctcgctgcaaagaccaagggagtattcaccaacccagctcttgtagagccgttcggcctcacaatcatcgaggctgctgcttacggtttgccggtggtcgcaaccaagaacggagggccggtggacatcctcaaggcgctcaacaacgggctgctggtggacccgcactcggcggaggcgatcaccggcgccctgctgagcctgctggccgagaagtcgcggtgggtggagtgccgccgcaacggcctccgcaacatccaccgcttctcgtggccgcaccactgccgcctctacctctcccacgtctccacctactgcgaccagccctcgccgcaccagcctctccgcgtgcccctcggcctgggctcctcgaccagcttcggcgcagacgactcgctctcggactcgctccgcggcctctcgctccagatatccgtggacgcctccagcgacctcaacgccgcggactccgcggccgccatcatggacgcgctccgccggcgcccggcctccgagaagccggcgagctccggtgccagggcgctcggcttcgcgcccggccggcgggagagcctcctggtggtcgccgtcgactgctacggcgacgacggcaagccggacgtcaagcagctaaagaaggccatcgacgcggcggtgtcggttggtgaatgcgcgggagctaagcaggggtacgtgctgtcgaccggcatgaccatccccgaggccgcggaggcgatcaaggcgtgcggcgccgacgttgccagcttcgacgcgctgatatgcagcagcggggccgagctatgctacccgtggaaggagctcgcggccgacgaggagtactccgggcacgtcgcgttccggtggcccggtgaccacgtgaaatccgccgtgcccaggctcgggagcttggaggagatcgccctcgcaatcgatcgccccgcctgctccgtgcactgccacgcctacgccgccacggacgcatccaaggtgaagaaggtggattcgatcaggaagtcgctgcggatgcgcgggttccggtgcaacctcgtctacacgcgcgcgtgcacgcgcctcaacgtcatccccctctccgcttcccggccgcgcgctctcaggtacctgtcgatacagtgggggatcgatctctccaaggtggcggtgctcgtcggcgagaccggcgacaccgaccgcgagaggctcctcccgggagttcacaagacgctcatcctgccgggaatggtcgcccgcggcagcgaggagctcctccgaggcgacgacgggtacaccatggcggacgtcgtggccatggactcccccaacattgtcacgctcgccgaaggccagtctgcctccgacctcctcaaggccatctgagagcgtgctctgctgctccctgtgctgcttctgttttccacatctgggacgcagtagcttcacttggattgtttcgcctgtgattttggcaggaagatgatgactgcagaattgcatttgcatataccgtatacctgtgcaagcatgagcaaaacatgtcagctaataattctttaatgttttggtcatgcctccgtgaggtatgcttgtgtgcattctataaaagaaaaacgcaagaatgaaagaaagaaatattttcaatgtaagttgatgtttcttcctgacggcttcttacttggattgtctacattaattgtttcaaggaaatacaaggatctcccctctccaaaaaaaaaa

SEQ ID NO: 131 - DNA, 3747 bp, Lolium perenne
ctccgatcccccacccacctcccaatttccccaagccgcatcgcatcacctcgtctcccgagagcaccgcgatggcggggaacgactggatcaacagctacctggaggccatcctcgacgcgggcggcaccgcgggggacatctcggccgcctctgtggccggaggcgatgatgggccgggcgctggcggaggcactgcgggggagaagcgggacaagtcgtcactcatgctccgagagcgcggccggttcaaccccgcgcgctacttcgtcgaggaggtcatctccggattcgacgagacggacctctacaagacctgggtccgcacgtcggccatgagaagcccgcaagagaggaatacgcggctggagaacatgtcctggaggatctggaacctcgctaggaagaagaagcagattgaaggtgaggaagcctcccgtttatcaaagaaacgtcttgaacgtgagaaggctcgtcgagatgctgctgctgatttgtctgaggacctatctgagggagaaaaaggagaaaacattaacggatcatctgttcacgatgagagcacaaggggacgaatgccaaggataggttcaactgatgctattgaggtgtgggcaaatcagcacaaagataaaaaactgtacatagtgctaataagtattcatggtcttatacgtggtgagaatatggagcttgggcgtgattcagatacaggcggtcaggtcaaatatgttgtagagcttgctagggcattaggtgaaacacctggagtatacagagtggatctgctgacaaggcagatttctgcacctgatgttgactggagttacggagaacctacagagatgctgagtccaagaaattctgagaaccttggggatgacatgggtgaaagcagtggtgcttatattgttaggataccttttggaccaagagaaaagtatatacctaaagagcagctctggccccacatacaggaatttgttgatggtgcacttgtccatatcatgcagatgtccaaggttcttggtgaacaagttggtcgtgaacggcgagtatggcctgttgttatccacggacactatgctgatgcaggcgattctgctgctctattatctggggcactcaatgtcccaatggtattcacaggtcattctcttggcagagacaaattagagcaacttttgaagcaaggacgtcaaaccagggacgaagtaaatgcaacatacaagataatgcgtcggattgaagctgaggaactttgtcttgatgcatctgaaattgtaattacaagcactaggcaagaaatagagaaacaatggggattgtacaatggatttgatgtaactatggagaggaaacttagagcaagaacaaagcgtggtgtcagctgctatggtcgttacatgcctcgtatgattgcgattcctcctggcatggagtttagccatattgtgcctcatgatgttgacctggatggtgatgaagcaaatgaagttggctcaggttcaccggatccacctatttgggctgatataatgcgtttcttctcaaaccctcgtaagcccatgattctcgctcttgctcggccagatcccaagaagaacatcactacattggtgaaggcatttggtgaacaccctggattgagaaatttagcaaaccttacactgatcatgggtaaccgtgatgttattgatgaaatgtcaagcacaaatggagctgttttgacctcagtactcaagttaattgacaaatatgatctatatggccaagtggcataccccaagcaccataagcaatctgaagttccagatatttatcgtttggcggcaagaacaaagggggtttttattaattgtgcttatattgaaccatttgggctcaccttgatcgaggctgctgcttatggtctaccgatggttgctacccaaaatggtgggcctgtcgacatacaccgggttcttgacaatggtatccttgttgatccacacaaccaaaatgatattgctgaggcactttataagcttgtttctgataagcacttgtgggcacaatgccgtcagaatggtctggataatatccatcgattttcttggcctgaacattgcaagaactatttgtcacgggttggcacggtgaagcctagacatccacgatggcaaaggagtgatgatgctactgaagtttctgaatcagattcacctggcgattctttgagggatgttcatgatatatctcttaacttgaagctttccttggacagtgaaaaagcaggcaccaagataaatactgaacgaaattccaccaatgccagaagaaatcttgaggatgctgtactaaaattttcaaatgctgttagtgagggcacaaaggatgagtctgatgagaatgctgaggccaccacaggctccaataaatggccatctttacggaggagaaaacacattgttgttattgctgtagattctgtgcaaaatgctgacttggttcagattatcaaaaacctttttgaggcttcacgcaaagaaaaatcatctggtgctgttggttttgtactgtcgacatctcgagcaatatcagagacacttacttttttaacatctgggggcatacaaactactgaatttgatgccttcatatgcagcagtggcagtgatctttgttatccatcttcaagttcggaagacatgcttagccctaccgagcttccatttatgattgatcttgattatcactctcagattgaataccgttggggaggggaaggtttaaggaagacactaattcgttgggcagcagaaaacaacagtcagagtggacaagaagtagttactgaagatgaagaatgttcatccacttactgcatttcatttaaagtgaagaatactgaggctgtccctcctgtgaaggatcttagaaaaacaatgagaattcaagcactgcggtgtcatgtattgtacagccatgatggtagcaagttgaatcttatacctcttctagcatcacgatcccaagcactaaggtacttgtatatacgatggggggtagagctggcaaacatgacagtggttgttggtgaaagtggtgatacagattatgaagggctacttggaggcgtgcacaagaccatcatactcaaaggctcatttaatgctgctccaaaccagcttcatgctgccagaagctattcactggaggatgtcatatcgtttgacaaaccaggaattgcttcagtcgagggatatctcccagatagcttaaaatcagctctacaacagttcggtgtgctgaactaaagtgacaatcttgccatcagcagaacagttaagtagagtatctattctatgtggtccagatcgagaaatgtgcagcaaggcttgtcttcgctgttttaccacgtcttgcatggcagaataagttctggttgaggtttaccttctacaactcttcttgtaaaccaaaagaatttggagctacgaacttggatcagttttttgtccaaggcaaaactcaaggcaataatactgtgccctaccatcagtcacaataaagcaagattgaacatccttcttgagattcgttaatgttttgtaagactagtcatagtggggagtaatttatatgttgtttcatgcattgtattatttattatcttgtaaacccattttgttttggtgtgtgtgatgttattatggtaacatagctagttaccaccctattatatttcttccctcaaaaaaaaaa

SEQ ID NO: 132 - DNA, 3743 bp, Lolium perenne
cacgcgcgcccgtgcgcacacgtatatagcccgatcaatatcaagttgggatctttagcgccggaggagcggagtagcctgctcgccggcgagggtaattagagcaagaggagtctgctcgccgtcaacaaagatggcggcggggaacgagtggatcaacgggtacctagaggcgatcctggacgcggggtcgaagctgcggccgcagggcgtgcagctgccgccgctggagacagcgccggcgctcgcggccgaggagagcagcgccgcctacaacccgaccaggtacttcgtggaggaggtggtcaggagcttcgacgagcaggccctccacaagacatggacaaaggtggttgcgatgcggaacagccaggagcggagcaaccggctggagaacctgtgctggaggatctggaacgtctccaggcagaagaagcaggtggagtgggattacacgaaagaggtggctcggcggaagcttgagcaggagctgggcagccgggaggccgccgaggacctatccgagctctccgagggcgagaaggacaccaccaccgccaagcccgacgccgcagccgctcaaccgtccgccgacgatggcgagcaccagcagccgcagccacgcacccggctcgcgaggatcaactccgaggtgcggctcgtctccgacgacgaggaggagcagaccaagaagaggaacctctacatcgtcctcatcagcatccatgggctggtgcgcggggagaacatggagctcggccgagactccgacaccggtggccaggtgaagtacgtggtggagctggcgcgtgcgctggcggcgacggcgggggtgcaccgggtggacctgctgacgcggcagatctcctgcccggacgtggactggacctacggcgagcccgtggagatgctggagcgcctgtcgtcggcggacgccgacgacgacgacggcgagcaggccggcggcggtgcctacatcgtgcggctgccgtgcgggccaagggaccagtacatccccaaggaggagctgtggccgcacatccccgagttcgtggaccgcgcgctctcgcacgtcaccgaggtcgcccgcgcgctcggcgagcagctccagcctcctccttctccggccgacggcgcggtggcggcgcccatctggccgtacgtgatccacggccactacgcggacgcggcggaggtggcggcgaacctggcgagcgcgctgaacgtgcccatggtcatgacgggccactcgctggggcgcaacaagctggagcagctgctcaagctcggccgcatgccgggccccgagatccagggcacctacaagatcgcgcgccggatcgaggccgaggagacggggctcgacaccgcggagatggtggtcaccagcaccaagcaggagatcgaggagcagtggggactctacgacggcttcgacctcatggtggagcgcaagctccgggtaaggcagcgccgcggcgtcagcagcctcggacggtacatgccgcgcatggcggtcatcccgcccggcatggacttcagcttcgtcgagacacaggacacggctgacggggacggcgccgatctccagatgctcattgctcccgacaaggccaagaaggctctgcctcccatttggtcagacgtgctgcggttcttcacgaacccgcacaagccgatgatcctggcgctgtcgcggccggacccaaagaagaatgtcaccacgctgctcaaggcctacggcgagagccgccagctccgggagctcgcgaacctgacactgatactggggaacagggatgacatcgaggacatggccggtggcggcggcgcggtgctcacggccgtgctcaagctcatcgaccgatacgacctctacggccaggtggcctacccaaagcaccacaagcagacggacgtgcctcacatctaccgcctcgccgccaagaccaagggagtattcatcaacccagctcttgtggagccgttcggcctcacaatcatcgaggctgctgcttatggtttgccggtggtggcgaccaagaacggcgggccggtggacatcctgaaggcgctccacaacgggctgctggtggacccgcactcggcggaagcgatcaccggcgcgctgctgagcctgctggctgagaagtcgcggtgggtggagtgccgccgcaacggcctccgcaacatccaccgcttctcgtggccgcaccactgccgcctctacctctcccacgtctccacctactgcgaccagccctcgccgcaccagccgctccgcgtgcccctcgccctgggctcctccaccagcttcggcgccgacgactcgctctcggactcgctccgcggcctctcgctccagatatccgtggacgcctccagcgacctcaacgccgcggactccgcggccgccatcatggacgcgctccgccggcgcccggcatccgagaagccggcgagctccggtgccagggcgctcggcttcgcgcccggccggcgggagagcctcctggtggtggccgtcgactgctacggcgacgacggcaagcccgacgtcgagcagctgaagaaggccatcgacgcggcggtgtcggttggtgaatgcgcgggagcgaagcaggggtacgtgctgtcgaccggcatgaccatccccgaggccgcggaggcgatcaaggcatgcggcgccgacgttgccagcttcgacgcgctgatatgcagcagcggggccgagctatgctacccgtggaaggagctcgtggccgacgaggagtactccgggcacgtcgcgttccggtggcccggtgaccacgtgaaatccgccgtgcccaggctcgggagcatggaggagatcgccctcgcaatcgatcggcccgcctcctccgtgcactgccacgcctacgccgccacggacgcatccaaggtaagcataacagagcactacttgtagtaaccactaaccagcacggtacatggtctcctccatgcctaagcttctgatgcgtggggttttgggcaggtgaagaaggtggattcgatcaggcaggcgctgcggatgcgcggcttccggtgcaacctcgtctacacgcgcgcctgcacgcgcctcaacgtcatccccctctccgcttcccggccgcgcgctctcaggtacctgtcgatacagtgggggatcgatctctccaaggtggcggtgctcgtcggcgagaccggcgacaccgaccgcgagaggctcctcccgggagtgcacaggacgctcatcctgccggggatggtcgcccgcggcagcgaggagctcctccgaggcgacgacgggtacaccatggcggacgtcgtggccatggactcccccaacattgtcacgctcgcggaaggccagtctgcatccgacatcctcaaggccatctgagagcatgctctgctccttgtgctgcctctgttttccacatcccggacgcagtagctccacttcgattatttcacctgtgattttggcaggaagatgactgcagaattgcatttgcatataccgtatacctgtgcaagcatgagcaaaacatgtcagctaataattcttttatgttttggccatgcctccgtgaggtatgcttgtgtacatactataaaggaacagagagagaaacgcaagaatgaaagagagaaatattttcaatgtaagttgatgtttcttcctgacggcttcttacaatggcttgtctacattaattgtctcaagaaaaaaaaaa

SEQ ID NO: 133 - DNA, 2714 bp, Lolium perenne
cttctcccctcacacgcctcgccatttgttttgtgtcctgagccatggctgccaagctgactcgtctccacagtctccgggagcgccttggtgccaccttctcctcccatcctaacgagctcattgccctcttttcaaagtatgttcaccagggcaaaggaatgcttcagcgccaccagctgctcactgagtttgaagccttgtttgaggctgacaaggagagatatgcaccctttgaagacattctccgtgctgctcaggaagcaattgtgctgcccccatgggttgcactggccatcaggcctaggcctggtgtctgggactacatacgggtgaatgttagcgagttggctgttgaggagctgacagtttccgagtacctggcattcaaggaacagcttgttgatgagcacgccagcagcaagtttgtgcttgagcttgattttgagcctttcaatgcctccttcccacgtccttccatgtccaagtccattggaaatggggtgcagttccttaaccgtcacctgtcttccaagctgttccaggacaaggagagcctctacccactactgaacttcctgaaagcccataaccacaagggcacgacaatgatgctaaacgaccgaattcagagccttcgtgggctccaatcagcccttagaaaggcagaagagtatctaacgagcattcctgaagacaccccgtcctctgagttcaaccacaggttccaagagcttggcttggagaagggttggggcgacaccgctaagcgtgtacaggacaccatccacttgcttcttgatctacttgaggcccctgatccagccagcttggagaagttccttggaactataccaatgatgttcaatgttgttatcctgtctccacacggatattttgctcaatccaatgtgttgggataccctgatactggtggccaggttgtgtacatcttggatcaagtccgtgctttggagaatgagatgcttctgaggattaagcagcaaggccttgacataacccctaagatcctcattgtcaccaggctgttgcctgatgctgttggaactacatgtggccagcggctggagaaagttattgggactgagcacactgacattctccgtgttccattcagaactgagaaggggatcctccgtaagtggatctctcgttttgatgtctggccatacctggagacatacaccgaggatgttgcaaacgaactcatgagagaaatgcagaccaagcctgatctcattattggcaactacagtgacggtaaccttgtcgccactctgcttgcgcataagttgggagttacccagtgcaccattgcccatgctttggagaaaacaaaataccccaactcagacatatatttggacaaattcgacagccaataccatttctcatgccagttcactgctgaccttattgccatgaatcacactgatttcatcatcaccagcacattccaggaaattgctggaagcaaggacagcgtgggccagtatgagtctcacattgctttcaccctccctgatctctaccgtgttgtccatgggattgacgtgttcgatcccaagttcaacattgtctctcctggagcagatatgactgtctacttcccatacactgaaactgacaagaggcttactgccttccaccctgaaattgaagagctcctttacagtgatgttgagaactctgaacacaagtttgtattgaaggacaagaacaagcctatcatcttctcaatggctcgtcttgaccgtgtgaagaacatgacaggcttggttgagatgtttggtaagaatgctcatctgaaggatttggcaaaccttgtgattgtcgctggtgaccatggcaaggagtccaaggatagggaggagcaggctgagttcaaaaggatgtacagtctcattgaggagtacaagctggagggccatatccggtggatctcagctcagatgaaccgtgttcgcaatgcagagttgtaccgctacatttgtgacaccaagggcgcatttgttcagcctgcattctatgaagcatttggcctgactgttgtcgaggccatgacatgtggtttgcccacaatagcgacatgccatggtggcccagctgaaatcattgtgaatggtgtgtctggtttgcacatcgatccttaccacagtgacaaggctgcagatatcctggtcaacttctttgagaaatccacggcagatccaacctactgggacaaaatgtcggaaggtggcctgaagagaatttatgagaagtacacctggaagctgtactcagagaggctgatgaccctgactggtgtatatggtttctggaagtatgtgagcaaccttgagaggcgtgagactcgccgttaccttgagatgttctacgctctgaagtaccgcagcctggctgctgcagttccattggccgtcgatggcgagaacacggacaattagtgcgggacatgaagaggcgccttcaaagggcgaggtgtcggctgcgttatgatttgattgtctaccggagttttcatttggtctattgtggagtgtgtacttggatgtctcaggcacttctgtgaggttttgggcagttctttgctggttcctgctagctgcatatgttgtcttcaataaacgcctgcccgtattgttcatctcttataattcaatgcaatcttctgttgcctaaaaaaaaaa

SEQ ID NO: 134 - DNA, 2957 bp, Lolium perenne
cggtttcttcctcgtggtgcgttgcgtttgtcgggttcttctgaagaagcggaaggtttgagcaatgggggaagccgccggcgaccgtgtgctgagccgcctccacagcgtcagggagcgaatcggcgactccctctccgcccaccccaatgagctcgtcgccgtcttcaccaggctggtcaaccttggaaagggaatgctgcagccccaccagatcatcgctgagtacaacactgcaatccctgaagcagagcgcgagaagctcaaggacggcgccttcgaggatgtactgagggcagcgcaggaggcaatcgtcatctccccatgggttgcacttgccatccgccctaggcctggtgtctgggagtatgtgagagtcaacgtgagcgagcttgctgtcgaggagttgagtgtccctgagtacttgcagttcaaggaacagcttgtggaaggaagcaacaaagacttcgtgcttgagctggactttgagccattcaatgcctccttccctcgtccttccctgtcgaagtccattggcaacggtgtgcagttcctcaataggcacctgtcatcaaagctcttccatgacaaggagagcatgtaccctttgctcaacttcctccgtgcacacaactacaagggcatgcctatgatgatgaacgacagagtccgcagtctaagtgctctccagggagctctgaggaaggccgaggagcatctgtctggtcttccagcagacaccccgtactcggacttccaccacaggttccaagaacttggtttggaaaagggctggggtgattgtgccaagcgtgcgcaagagacccttcacctgctcctcgaccttcttgaggcacctgacccgtccacacttgagaagttccttggtacaatcccaatggtgttcaatgttgtcatcctctctccacatggttactttgcacaagccaatgtcttggggtaccctgacaccggagggcaggttgtctacattttggatcaagtccgtgctatggagaatgagatgcttttgaggatcaagcagcaaggactcgatatcacaccacggatccttattgttaccaggcttctccctgatgcaaccggtacgacctgcggtcagcgtcttgagaaggtcctcggtactgagcacacccacatccttcgtgtgccattcagaactgaaaatggaattgttcgcaaatggatctcacgttttgaagtctggccatacctggagactttcactgatgatgtggcgcacgagatttctggagagctccaggccaaccctgacctgatcatcggaaattacagtgatggaaaccttgttgcatgtttgcttgcacacaagatgggcgttactcattgtaccattgcgcatgcgcttgagaaaaccaagtaccccaactctgacctgtactggaagaagtttgaggatcactaccacttctcatgccagttcaccactgacttgattgcaatgaaccacgcggacttcatcatcacaagtaccttccaagagattgctggaaacaaggacaccgttggtcagtacgagtctcacatggcattcacgatgcctggaatgtaccgtgttgtccacggtatcgatgtttttgaccccaagtttaacatagtttcgcctggtgcggacatgtccatctacttcccgtactcagagtcacaaaggaggctcacctcactccacccagagattgaggagctgctctacagtgatgtcgacaacgatgagcacaagtttgttctgaaggacaggaacaagccaatcatcttctcgatggctcgtctggaccgtgtcaagaacttgactggtctggttgagctgtatggccggaaccctcgcttgcaggagcttgttaaccttgtggttgtttgtggtgaccatggcaacccatcaaaggacaaggaggagcaggctgagttcaaaaagatgtttgaccttattgaacagtacaacctgaatggccatatccgctggatctctgctcagatgaaccgtgtccgtaatgctgagctctatcgctacatctgcgacaccaagggtgcttttgtgcagcctgcattctatgaggctttcgggctaactgtcatcgaggccatgacctgtggtcttccaacatttgcaactgcatatggtggtccagctgagatcatcgtgaacggtgtctccggctaccacattgatccttaccagggtgacaaggcctcggctctgctcgttgagttctttgagaagtgccagggagaccacagccactggaccaagatctcactgggagggcttcagcgtattgaggagaaatacacctggaagctttactctgagaggctgatgaccctcaccggtgtctatggcttctggaagtacgtctccaaccttgagaggcgtgagacccgccgctacctggaaatgctgtacgcgctcaagtaccgcaccatggccagcactgttccattggctgtcgagggggagccctcgagcaagtgatctggccacctatcggccggaagaagaagaagaaggttggcttcgatttctgaaagatttgagatttgagaatgcgttggttttcttcctaggcgctgctcttttagagttaaggtcgagttgatgtgctagtttgattcagcagtgggagtgagttgagacagaaggatgtggtgtgtgccagtattgttggtgcttttcgtgttctttggatgttacccttgaataatagtagcggccttggcgccgtttctgaaataatagtagcatccttgctcgttgccaagaaaatcttagtttttttttctcttgaacaagtggcaaagcgacctctgcatctatctctgtcattgacatttagctctgttgcggtgcactggataccttacattgctctagagaacagcaataaaagccggaccatgtgattgctgtaaaaaaaaaa

SEQ ID NO: 135 - DNA, 1986 bp, Festuca arundinacea
gaaacttctcatcccacaggccacagagcatccccacacatcctatctccctcctcgtgctccttctgtcgccatggcccaagcttgggccttcttcctcctcgccctcttctccttctcctcctatgtatccaggatcttcctctgcagcaggaatggcgagggatccttcctctgtgcacgggcaccagaggtcccctccattgctagcgacaggtaccggaccgcctaccacttccagccccacaagaactggatgaatgatccaaatggaccgatgtactacaatggcatctaccatttattcttccagcataaccccaatggcccccaatggggtgacatagtctggggccattcggtttcgaccgaccttgtcaactggatcatacttgaacccgcaatagaaccggatacaccaggtgacataaaaggttgctggtccggctcagccacagttatatctggtagtcaaccggtcatcatgtacaccggtggcgatgtagagaatcatcaggttcaaaacattgcgcttcctaagaaccggtctgacccgtaccttatagaatggaccaaggcatgcaataacccagtgctccaaccggttggaccaggaatgaacccaggcgagttcagggatccgacgacaggttggatcgggccggatggactatggagaatatcaattggagctgaggtgaacggttacagtgcagcacttttgtacaagagtgaagactttctgaattggagtagagttgatcacccactgtattcatccagtgcctccactatgtgggagtgcctggacttcttcgcggtattaccgggcagtaacggtggactggacctgtccgcagctattccgaaaggcgccaaacatgtcctcaaagtcagcgtggatcaatgtgacaagtacatgattggggtttatgatctcgaacatgatgcttttgtgcctgatactatcctcgatgaccgttggttgttgccgaggatcgattacggcaattactatgcttcaaaatcgttcttcgactcgaaaaataggaggaggatcatatggggttggactaatgagtcagatagttcttcagatgatgtcgcaaaaggctgggcaggtatctatgcaattcccaggacaatttggctagaccgtgatggcaagcagttgctgcaatggccagttgaagagattgagtcccttcgaagaaatgaaatcaactatcaaggactagatctggagaagggagatctttatgagattaagggagttgacactttgcaggctgatgtggagatagattttgagctgacgtctattgatgatgccgactcttttgatccttcctggcttttggatcccgaaaagcattgccgggaagcgggtgcatcagttcatggtggtatagggccatttggacttgttattctggccaccggcgacatggaggagcacactgttgtgcacttcagagtctacaaatcacagaaagaatacatgatactcatgtgctctgatataagaaggtcttccctgagacaaggactgtacgcacctgcctatggaggcttctttgaatttgatcttgaaaaggaaaggaagatatctctgagaactctaattgatcggtcggcggtggagagctttgggggcggtggcagggtctgtatcatagctagagtttatccagtggcgattgtcgatgacgggagtgcccacatgtatgccttcaacaatggaagtaccacggtcagggtgccacagatcagggcatggagcatgatgacagcacaagtgaatttaaagaaaggctgaagtgatgattaacacagaaaagctaattccttttattgattctttctcttattcatgagcactcattcgtacaaataaacggaaattcaacaggcatatgtaattgattgtttccttgatctcaattattcatatactataattattattaaaaaaaaaaaaaaaaa

SEQ ID NO: 136 - DNA, 2073 bp, Lolium perenne
gaaaactagattattgtccagtctccttgacttgcattaaactttgcgatctggacggctataactgcgccctgaaagccttctgcaatttacacatcgatcggccagcccatccatcagtacctttgtcccctcttggtcttcctctccgattccgattcgcaccaccatgaatggaatcgagcacccgggcaatggccggaccgcctaccacttccaaccggcgaagcattggcagaatgatcccaatgggccaatgtaccacaacggcctgtaccacttcttctaccagtacaatccccacggcccgacctgggacaccggcaagttatcatggggtcactccgtctccggcgacctcgtgaactgggccgccctcgacaatgctctcgaccccaccgccccgttcgacgccaacggctgctggtccggctccgccaccatcctccccggcggccgcccggccatcctctacaccggcatcgacgccgacaaggtgcaggtgcagaacgtggcattcgccaaggacccctccgacccgctcctccgcgagtgggagaagcccagctgcaacccggtgatcccgtaccccgccgacgtgacgggcaacaacttccgtgatccgacggaggcgtggcgcggccgcgacggcctgtggcgggtcggcatcgtcgccgaggtgaagggcgtggggtccctgctcgtgtaccggagcgcggacttcctccgctggcagcgcaacgccgcgccgctgcacgccagctcgcgggacgtgcccgtgctggagtgcccggacctgttcccggtggctgcggcggcgcagggcgcgacggaggggctcgagacttcggcaccgagcggcgccggggtgaggcatgtgctcaagctcacggacttcgccaaggaggaccactacatggttgggttttacgacgacgtggcggacaccttcgtgccggcggagcccgagcgcggcgacgaccccgacaactggcgccggctcgaccacggccacctgtacgcgtccaagtccttctacgacgcgcgcaacaagcggcgcatactgtgggcgtgggtggacgagaccgacggtggcggcgtcgccaggggctgggccggcatccaggcgttcccgagggcgatgtggctggacgccgacgggaagcggctggtgcagtggcccgtggaggagatcgagacgctgcggaggaagcgggtcggcctgcggtgggcgacggacgtggaggccggcggcaggaaggagatcgccggcatcgtgagctcgcaggcggacgtggaggtcgtgttcgagatcccgaacctggaggaggccgagacgttggaccccgagtgggtgctggatccgaaagggctgtgcgcggcgaagggcgcgtccgtgcacggcggcgtcggcccgttcgggctgctcgtcttggcctccggtgacctggaggagcacactgctgtgttcttcagggtgttcaagcacgatggcaagtacaaggttctcatgtgcaccgatctcacaaagtcatctacgaaagcaggggcacacaagccatcctatggagcatttcttgatgtggacgtggagaaggacaagttcatatcgctcagaacattgatcgatcacacggtggtggagagcttcggcgacggcgggaggacgtgcatgacggctcgtgtgtaccccgaacacgcggcgatgggaagcacccacctgtacgtgttcaacaacgggacaggtgccgtaaaggtgtccaaacttgaggcgtgggagctggcgacggcggccgtgaacggcggctcgcttgcacccgtcgtcgtcaaggcatccgaccctaaagaggccttgtagttctagggtatgcccgggatggtggctgcttagatgatgtccgtcgttgatttatgcttgttggtcgagttatgagtttcgggtaggatgatttatgcggaaatgcaattttagtggcgtcatgacctattggacaaacatctgtcattggaaaaacgtggtgatatgtccacgcccatatctaaaggtataatagaggcatcccaaaaaaaaaa

SEQ ID NO: 137 - DNA, 1888 bp, Festuca arundinacea
gaaaatctccttcagctcctgccctccatggcccatgcttgggccttctttctccttgccctcttctccttctcctcctgtgtgtccaagctcttcatctacagcaggaatggcgagggatccttcctctgtacacggtctccggaggtcccctccattgccagcaagaggtacaggactgcctaccacttccagtctcccaagaactggatcaatgatccatgtggacccatgtactacaatggcatttaccatgaattctaccagtataaccccggtggcaccatcgcggctaacatagtttggggccattcggtttcaaccgaccttgtcaactggatccagcttgaacctgcaatagtacgggataccccatatgacatacacggttgctggaccggctcaatcacaattctacctggtgatcagccggtcatcatatacaccggtcgtgactcggacaatcatcagagccaaaacattgagctccccaaaaaccgatctgacccatacctgagggaatggaccaaagcagacaataacccgaggatcctaccggttggaccagacttgaacttgacccagttcagggatccgacaaccggttggattggaccggatggactatggagaatagcaattggtgctgagctgaatggctacggtgccgcacttttgtacaagagtgaagactttctgaattggactagagttgatcacccactgtattcagacaatgccccctcaatgtgggagtgcccagatttcttcgccgtattgccaggcaataacggtggactggacctgtctgcggcgatcccgaaaggcgccaaacatgtcctcaagatgagcgtggattactctgacaagtacatgattggggtttatgatctcaaacgtgatgcctttgttccggatgttgtcctagatgaccgtcggctgtggttgaggattgattacggcacattctatgcttcaaaatccttcttcgactcgaaaaggggcaggagggtcatatggggttggtccaacgagacagatagtgtttcagatgatggtgcaaaaggttgggcaggtatccatgcaatccccaggtcaatttggttagacagcgatggcaaacagttgctgcaatggccgattgatgagattgagtcccttcgaagagatgaaatcaaccatcaaggactagagctgaagaacggagacctatttgagattaagggaattgacactttgcaggctgatattgaagtagattttgagctgacgtccatcgacagcgccgatccttttgatccttcctggcttttggatgtcgagaggcattgccgggaagcaggtgcatcggttcaaggtggcatagggccatttggacttgttgtcctggcgtctgacaacatggaggagcacattgctgtgcacttcagagtttacaaatcacagaaaagccacatgatcctcatgtgctctgatctaagaaggtcttctctgagatcaggactgtacacaccagcctatggaggcttctttgaatttgaccttgaaaaggaaaggaagatatctctcagaactctgattgatcggtcagcggtggagagctttggcggcggtggcagggtctgcataacggccaggatttatccagtggcgcttgtcgacggcagggtccacatgtatgccttcaacaatggaagtaccacggtcagggtgccacaactcggggcatggagcatgatgacagcacaagtgaacgtgaataagggttgaagtgatggttaacacagaagagcagtttcattttcttaattagcgtactctcattcaggagcactccttggtacaattgaaaggaaattcgacaggaagtagttggtcaaaaaaaaaa

SEQ ID NO: 138 - DNA, 1849 bp, Lolium perenne
aaagttcatccctccttctgtccccatggcccaaggttggcccttcttcctccttgtcctcttctcctcctgtgtatccaaccacctcgtcaatggagaaagggtcttcctcttcccccagtctcacaaggtctcctccattgtcagcaagaggtataggactgcctaccacttccagccccccaagaactggatcaatggaccaatgtactacaatggtatctaccatgagttctaccagtacaaccccaatggctccctctggggtaacataatttggggccattcagtttcgacggacctcatcaactggatcccagtagaacctgcgatagaacgggatatcccaagtgacataaacggttgctggaccggctcagccacaattatttccggtgatcaaccaattatcatatacaccggagccgacaaggagaaccgtcagctccagaacattgtgcttcccaaaaacaagtctgacccgtatctgagggagtggacaaaagcaggtaataacccggtgatccaaccagtcgggccaggcttgaatgcgagccagttcagggatccgacaaccggttggattggaccggatggactgtggaggatagcagttggtgctgagcttaatggctacggtgctgcacttttgtacaagagtcaagactttctgaattggactagagttgatcacccgctgtattcatccaatgcatcctcaatgtgggagtgcccagattttttcgcggtattgccgggaaatagtggtggacttgacctatctgcagaaatcccaaatggcgccaagcatgtcctcaaaatgagcctagattcctgtgacaagtacatgatcggagtttatgatctgaaaagtgatacctttatgccagatagtgtgttagatgaccgtcgactgtggtcgaggatcgatcatggcaatttctatgcttcaaagtcattcttcgactcgaaaaagggaaggaggatcatatggggttggacaaatgagacagatagctcttcagatgatgttgcaaaaggttgggctggaatccatgcaattcccaggacaatatggttagacagttatggcaagcagttgctgcaatggccaattgaagagatcgagtcccttcgaagaaatgaaatcagccatcaaggactagagctgaagaaaggagacctatttgagattaaaggaactgacacttcgcaggctgatgtggaggtagattttgagctgacatccattgataatgccgacccttttgatccttcctggcttctggatgtcgagaagcagtgccgagaagcaggtgcatcggttcaaggtggcatagggccatttggacttgttgtcttggcctctgacaacatggaggagcacactgctgtacacttcagagtttacaaatcgcagcaaagctacatgatcctcatgtgttctgatctaagaaggtcttccctgagatcaggaatgtacacaccagcatatggaggcttctttgaatttgaccttcagaaggaaagaaagatatctctgagaactctgattgatcggtcagcggtggagagcttcggaggcggtggcagggtctgcatcatggccagagtttatccggtggtgcttgtcgatgatggcggggcccacatgtacgccttcaacaatggcagtaccacggtcagggtgccacagctcagggcatggagcatgagcagggcagagcacaagtgaatgtaaagttaaagtgatgattaacatagaagagcaaatctaattgacctgtgattggaggactggaaaagtgatttaaatgcttagcacaattgtttcttgataaaaaaaaaa

SEQ ID NO: 139 - DNA, 2166 bp, Lolium perenne
gggaccttgcgcccaagtacgtagtctgacagcaatgggggttcgtctcgggagagtagcttgggcgtgcccggcggttctggtgctgctcttgcagctcgccggagcgtcccatgtcgtctacgagaccagcctcctcgagaccgaggcggcggcggccaccgtgccagcctccatttttgagctgagcaccgggtaccacttccggcctcagaagaactggatcaacgatcccaacgcgccgctgtactacaagggttggtaccatctgttcttccagtacaaccccaagggcgcggtgtggggcaacatcgtgtgggcgcactcggtgtcgcgcgacctcatcaactgggtggccctggagacggccctggcgccgagcatcgacgccgacaaatacggctgctggtcggggtcggcgaccatcatgcccgacggcacgccggtgatcatgtacacgggcgtcagccggccggacgtcaactacgaggtccagaacgtcgccttccccaagaacagctcggaccctctcctccgggagtgggtgaagccggcgcacaacccggtgatcgtcccggagggcggcatcaacgcgacgcagttccgggacccgaccacggcctggtacgcggacgggcactggcggatcctggtgggcgccctctccggcgcgtcccgcggcgtggcgtacgtgtaccggagccgcgacttccggcggtggacgcgggtgcggaagccgctgcactcggcgccgacggggatgtgggagtgcccggacttctacccggtgaccgtggacggcaaggagagcggggtggacacgtccgtggtgtccagctcgagggtgaagcacgtgctcaagaacagcctcgacctccgccgctacgactactacaccgtcgggacctacgaccggctgaaggagaggtacgtgccggacaaccccgccggcgacaagcaccacctgaggtacgactacggcaacttctacgcgtccaagacgttctacgacccgtccaagcgccgccgcatcctgtggggatgggcgaacgagtccgacaccgccgtcgacgacgtcgccaagggctgggccggaatccaggcgattcctcggaaggtttggctggacccaagcgggaggcagctgatgcagtggccggtggaggaggtggaggcgctcagggggaagaagccggtcagcctcaaggaccggatggtgaagcggggagaacacgtcgaggtcaccgggctacaaaccgcacaggctgacgtcgaggtgagcttcgaggtgccgagcctggagggggcggaggcgctggacccggcgctggccaacgacgcccagaagctttgcggcgtgaagggcgccgacgtggagggcggcgtggggcccttcggtctgtgggtgctggcgtcgtccaagctggaggagaggaccgccgtcttcttcagggtgttcaaggccgcgggcaacgtcaacagcaccaagcccctcgtgctcatgtgctccgatccaaccaagtcatctctgaacaagaacctgtaccacccgaccttcgcgggcttcgttgatattgacatggctaagggcaagatttctctcagaagcctgatcgatcaatccgtcgtggagagctttggggccggaggcaggacgtgcatcctctctcgcgtctacccgtcgctcgccattggcaggaacgctcacctccacgtcttcaacaacggcaaggcggacatcaaggtgtcgcggctcacggcgtgggaaatgaagaagccggcgctcatgaacggtgcctagatttagattcaggcaggagcaccatatgcatgattcctacatatgtgcttgaatttggctcaggcatgcgtctggggcgttattctgatgttaatttgacctctggtgaaacatgctagttttacaagggcgcgtacgtagctagctaggtttgcacgctgtgtaagtgaagggggtcattttgtatgcccccgggaataataaagatccatgcatagcctgaggtgggcatcggtagaaagttatttttctgaaacggggcaaaatatttgctccaatcaactactcctggcatggattaaaataaggagcaacaaagtagaagttttacaagaaagttaatgttttgattattaaaaaaaaaa

SEQ ID NO: 140 - DNA, 2137 bp, Lolium perenne
ccctcgcactagtcggccgaggcattcttcctagttgcttccatcgcatcgatctcgatccacagattctatgccaatggaggcaagagatggcgtctcgatgccctactcgtatgcggccctgccggaggacgccgaggcagcggtggttgggcgcggtcgccggaccgggcctctgttcgcagcgttgctgttgacgttggtcgccgcgctccttgccgtcgccgcgctggctggcgtcaggctcgttggcgagctgcctgccgggggcgtcgtcatgcccaaccacccgatggaagtcatggacgtcagcggtagcagagggcctgagtcaggcgtgtcggagaagacgtccggggccgccagcgagagcggcggcatgctgggcgccgacgccggcagcaacgcgttcccgtggagcaatgcgatgctccagtggcagcgcaccggcttccacttccagcccgagaagaactggatgaacgaccccaacggtccggtctactacaaggggtggtaccacctcttctaccagtacaacccggagggcgcaatctggggcaacaagatcgcgtggggccatgccgtgtcccgggacatgctccggtggcgccacctgcccatcgccatgttccccgaccagtggtacgacatcaacggcgcatggtcaggctccgccaccgtgctccccgacggccgcatcgtcatgctctacacgggctccaccaacgcctccgtgcaggtccagtgcctcgccttcccctccgacccctccgacccgctgctcaccaactggaccaagtatgagggcaacccggtgctgtacccgcctccgcacgtcggggagaaggacttccgggacccgaccactgcatggtacgatggctccgatggaatgtggcggatcgtcatcgggtccaaggataaccgccgcgccggcatggccttgacctacaagaccaagaacttccatgattttgagctcgttcccggagtgctgcaccgggtgccggcgacggggatgtgggagtgcatcgatttgtacccggttggcggcgcgaggggcattgacatgacggaggccgttgcggcggcatccaacagcggtggtggtgaagttttgcatgtcatgaaggagagctcagacgacgaccgacatgactactacgcgctagggaggtacgatgcagcgacaaacaagtggacaccgctagatgccgacgccgatgtcggcatcgggctgaggtacgattggggaaagttctacgcatccaagaccttctatgacccggccaagaagaggcgtgtgctatgggggtgggtcggcgagactgactctgagcgcgccgacgtggccaagggatgggcttccctacagtcgatccctcgcacggtggtgctagataccaagacgggcagcaaccttatccagtggccggtggtcgaggtggagacgctccgtaccaactccaccaatctcgggagcatcatcgtcgagcatggctccgtcttccctctcagtctccaccgggccacacagctcgacatcgaggcttccttccgcctggacccgctcgatgtcgccgccgcaaaggaggccgacgttggctacaactgcagcaccagcggtggcgcggccggtcgtggagcgctcggtccctttggcctgctcgtactcgccgatgccaggcgccatggcggggacacggagcagaccgccgtctacttctacgtcgcgaggggcctcgatggcaacctgcgcacgcacttctgccatgacgagtcacggtcatcccgtgccaacgacattgtcaagagggtcgttggcaacatcgtgccagtgctcgacggagaggcgctgtctgttagggttctggtggaccactccattgtcgagagcttcgcacagggtgggaggtcggtggtgacttcacgagtttacccgactgaggccatctacgccaatgccggggtatacctcttcaacaacgccaccggtgcccgggtcaccgccaccagtctcgtcgtccatgagatggacccctcctacaaccagaaccaggccgagatggcttcattgtaaatcgaaaatgtacatattgttttttgtgctagcatgttgcccgtaaaaaaaaaa

SEQ ID NO: 141 - DNA, 1954 bp, Lolium perenne
gaaagctttctttcctgtttgctcgctggtgcggccggcggcgtaccttctccggcgacgacatgcatgcagatcccaacggtccggtctattaccgcggatggtaccacctcttctaccagtacaaccccgagggggcggtctggggcaacatcgcgtggggccacgctgtctctcgggacctagtccactggcgccacctcccgctcgccatggtgcctgaccagtggtacgacatcaacggtgtctggacaggctccgccaccgtgttccccgatgggaccctgaacatgctctacacggggtccaccaatgcctccgtgcaggcccagtgcctcgccgtgcccgaggaccccaatgactccctcctccgcaactggaccaagcacgaagccaacccggtcctcctcccaccgcccgggatcggtgacaaggacttccgtgacccaaccaccgcatggttcgacgagtctgaccagacgtggcgcaccgtcatcgggtccaaggacaacaacggccacgccggcatcgccatggtgtacaagaccaaagacttcctcaactacgagctcatcccgggatacttgcatcgcgtcgacggcaccggcatgtgggagtgcatcgacttctaccccgtcggcggcaagaacggcagcgaggagctgtacgtgatcaaggagagcagcgacgacgaccgacatgactggtacacgctagggaaatacgacgcggcagccaacacgttcacggccgcggacccggagaacgacctagggattgggctgaggtacgactggggcaagttctacgcgtccaagaccttctacgacccagccaagaagcggcgcgtgctgtgggggtggattggcgagaccgactccgagcgcgccgatgtcgccaagggatgggcatccctcatgtcgattccgaggacggtggagctcgacgagaagacctggaccaacctcatccaatggccagtggaggagatcgagaccctccgcatcaagtccaccgaccttggtggcatcaccattgaccacggcagcgtctacccactccctctccaccgcgccacacagctagacatcgaggcctccttccgcctcgacgccgccaccgtcgccgccctcaacgaggctgacgtaggctacaattgcagcaccagcggcggctctacccaccgcggcgcactcggcccctttggcatcctcgtccttgccgacggtaaggcggagcaaacggcggtgtacttctatgtgtccaagggccttgacggggccctcgagacccacttctgccacgacgagtcgcgatcgacgctggccaaggatgtcgtgaagcgagtggtgggatacaccgtgcctgtcctcgatggtgaggcattttccgtgagggtgctcgtggaccactcaattgtggagagcttcgccatgggtggaaggtccacggcgacgtcgagggtgtacccgacggagtctatctacggcgctgctggtgcatatcttttcaacaatgccaccggcggctccgtgaccgttgagaagctcgtggtgcatgagatggactcgtcctacaaccagatcttcatggctgacgacttgtagtcaccgtcatccatggatagcgtcggatggtgaggatgatcacctactacatatacatacatactattgatcgaacgatcaccggatcggtcggtggtggcttcctctttctcttggatgcagaaggagatggagtactagctactctatttaccatgttgttgttttgttggttttttggggtttgggtttttgacgagatggatgaattagctatagatggatgattgtgtcctattttctctcctgccttccgagtgtaactacatatattggcaggatcgatgatatccctgttgcatgacagtgatgattaattattgtgatgatattgatcaaaaaaaaaa

SEQ ID NO: 142 - DNA, 2039 bp, Lolium perenne
aggaggtggtggaggagcacgaaatcccggccgccattcctccaccttccgctccgaccaaagatttccatccggcgagatccatgggctccatcgcggcagacttggcgccggaggcgcccgcggagctggtgttccggtcgaagctcccggacatcgagatcccgacccacctgacgctgcaagactactgcttcgagcgcctgccggagctctccgcccgcgcctgcctcatcgacggcgccacgggcgccgcgctcacctacggcgaggtggacgccctctcgcgccgctgcgcggccgggctgcgccgcctcggcgtccgcaagggcgacgtggtcatggcgctcctccgcaactgccccgagttcgccttcgtgttcctcggcgcggcccggctcggcgccgccaccaccaccgccaacccgttctacacgccccacgagatccaccgccaggccgccgcggccggcgccaaggtgatcgtcaccgaggcctgcgccgtcgagaaggtgcgcgccttcgccgccgagagagggatccccgtcgtctccgtcgacgaggccgtcgacgacggctgcctcccgttcgccgcgactctcctcggggaagaaagcggcgagcggttcgtcgacgaggcggtcgaccccgacgacgtggtggcgctgccgtactcgtccggcaccaccggcctgcccaagggcgtcatgctcacccaccgcagcctcgtcaccagcgtcgcccagcaggtggacggtgagaacccgaacctgcacttcagctcgtccgacgtgctgctgtgcgtgctgccgctgttccacatctactcgctcaactcggtgctgctcgccggtttacgcgccgggtgcgcgatcgtgatcatgcgcaagttcgaccacggcgctttggtggacctggtgcgcgcgcacggcgtcacggtggcgccattcgtgccgcccatcgtggtggagatcgccaagagcgcgcgggtgaccgccgcggacctggcgtcgatccggctggtcatgtcgggggcggcgcccatgggcaaggagctgcaggacgcgttcatggccaagatccccaacgctgtgctcgggcagggatatgggatgaccgaggccggccccgtgctagccatgtgcctggccttcgccaaggagccgttcgaggtcaagtctggctcctgcggcaccgtcgtccggaacgccgagctcaagatcgtcgaccccgacaccggcgcctccctcggccgcaacctgccgggggagatctgcatccgcggcaagcagatcatgaaaggttacctaaatgatccggaggccacaaagaacaccattgacaaggacggttggctgcatactggagacattggttatgtcgatgatgacgacgagatctttattgtcgacagactgaaggagataatcaaatataagggattccaagtacctccagcagaacttgaagcccttctcattacgcaccctgaaatcaaggatgctgctgtcgtatcgatgcaagacgaacttgctggtgaagttccggttgcgtttgttgtgcggactgaaggttcagagatcagcgaaaacgagatcaagcagttcgttgcaaaagaggttgttttctacaagaggatctgcaaagtgttcttcgcggattccattccaaagagtccatctggcaagatcctcaggaaggacctgagagcaaagctcgccgcaggcattcccggcagtgataccacacagtccaaaaactaagtcagatatattgtttcccaaccttacacacctctgtccaacaccatgtaatgttcttaatataaacggaaattattacatatagaagggctgattctttttactagatgtgtccaacatatgatatgtttgttaggccgatgatgtgtaacctgtcatgtatagataccgcctttttttgataagaaaggctgattataatgtataccatgagctgaatatttgttcaaggagatcaggattcggttgccaattgtttaccttttaaaaaaaaaa

SEQ ID NO: 143 - DNA, 2006 bp, Lolium perenne
gagagaggagatcaagcaagccatctcccacgactaatttagaagaagatttacttagtctctgcttctcgctcgatcgccggccggtgaggtagctagctagctactcgtactagatcattaccatgggttccgtgccggaggagtcagtggtgtccgtggccgcggcggagacggtgttccggtcgaagctccccgacatcgagatcaacaacgagcagacgctgcagagctactgcttcgagaagatggccgaggtcgcgtcccgcccctgcatcatcgacggccagacgggcgcctcctacacctacacggaggtcgactccctgacccgtcgcgccgcggcggggctgcgccgcatgggcgtggggaagggcgacgtggtgatgaacctgctccgcaactgccccgagttcgccttctccttcctgggcgcggccaggctgggcgccgccaccaccaccgccaacccgttctacaccccgcacgagatccaccgccaggcggaggcggcgggcgccaagctgatcgtcaccgaggcctgcgccgtggagaaggtgctggagttcgcggcggggcggggcctgcccgtggtcaccgtcgacgggaggcgcgacgggtgcgtggacttcgcggagctgatcgccggcgaggagctgcccgaggcggacgaggccgggatcctccccgacgacgtcgtcgccctgccctactcctccggcaccaccgggctccccaagggcgtcatgctcacccaccgcagcctcgtcaccagcgtcgcccagctggttgacgggtcgaacccaaacgtgtgcttcaacaaggacgacgcgctgctgtgcctgctgccgctgttccacatctactcgctgcacacggtgctgctggcggggctccgcgtcggcgccgccatcgtcatcatgcgcaagttcgacgtcggcgcgctggtggacctcgtccgcgcgcaccgcatcaccatcgcgccattcgtgccgcccatcgtcgtggagatcgccaagagcgaccgcgtcggcgccgacgacctcgcatccatccgcatggtgctctccggcgccgcgcccatgggcaaggacctccaggacgccttcatggccaagatccccaacgccgtgctcggacagggttacgggatgactgaggccgggccggtgctggccatgtgcctggcgttcgccaaggagcccttcaaggtcaagtccgggtcgtgcggcaccgtggtgcgcaacgcagagctcaaggtcgtcgaccccgacaccggcgcatccctcggcaggaaccagcccggcgagatctgcgtccgcgggaagcagatcatgataggttacctgaacgacccagagtctaccaagaacaccatcgacaaggacggctggctgcacaccggagatatcggcttggtggacgacgacgacgagatcttcatcgtcgacaggctcaaggagatcatcaagtacaagggcttccaggtggcgccggcggagctcgaggccctcctcctcacgaacccggaggtcaaggacgccgccgtcgtaggggtgaaggatgatctctgcggcgaagtcccggtcgccttcattaagaggatcgaaggatctgagatcaccgagaacgagatcaagcaattcgtctcaaaggaggttgttttctacaagaggatcaacaaggtctacttcaccgactccattcccaagaacccttccggcaagatcctaaggaaggacttgagagccaggctcgccgctggcatccccaccgaagttgccgcgccgagaagctaagggccgcttctcaggaacgcaatcacccatggtgctgtttaggtgctgttatagaccacaccaaatggggaaagaaactacgggaggggatcatattattcttgcaggagatatcagtttgttgattcgccctgcttgtgtaatgttgataaaatgaaatgatataatagatgtgttgttttattttttgaccatgtaaaaaaaaaa

SEQ ID NO: 144 - DNA, 1789 bp, Lolium perenne
ctcaacactcgccaatcccacagccacagaagccacctaccaccgctccaccgatcgacgatggaggtcctcctcctggagaaggccctactggggctcttcgcggcggcggtgctggccatcgccgtcgcgaagctcgccggcaagcgcttccgcctcccgcccggcccctccggcgcccccatcgtcggcaactggctccaggtcggcgacgacctgaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtccccttcttcaccaacaaggtggtggcgcagaaccgggtgggctgggaggaggaggccaggctcgtggtggaggacgtcaaggccgacccggcgtccgcgaccgccggcaccgtgatccgccgtaggctgcagctcatgatgtacaacgacatgttccgcatcatgttcgaccgcaggttcgagtccgtcgacgacccgctcttcaacaagctcaaggccatgaacgccgagcgcagcatcctgtcgcagagcttcgactacaactacggcgacttcatccccattctccgaccgttcctccgcaagtacctcaaccggtgcacaaacctcaagaccaagaggatgaagctcttcgaggaccacttcgtcgctgacagaaagaaggcgctggagcagaatggggagatcaggtgcgccatggaccacatcctggaggcggagaggaagggcgagatcaaccacgacaacgtcctctacatcgtcgagaacatcaacgttgcagccatcgagacaacgctgtggtcgatcgagtggggcatcgcggagctggtgaaccacccggacgtccagtcgaagctccgcgacgagatgaccgccgtgctgggcgccgacgtggcggtgacggagccggacctggagcgcctcccctacctgcagtccgtcgtgaaggagaccctccgcctccgcatggccatcccgctgctcgtgccgcacatgaatctcagcgacgccaagctcgccggctacgacatccccgccgagtccaagatcctcgtcaacgcatggttcctcgccaacgaccccaagcggtgggtgcgcgccgacgagttcaggcccgagcgcttcctcgaggaggagaaggccgtcgaggcccacggcaacgacttccgcttcgtgcccttcggcgtcggccgccggagctgccccgggatcgtcctcgcgctgcccatcatcggcatcacgctcggacgcctcgtgcagaacttccagctgctgccgccgcccgggcaggacaagatcgataccaccgagaagcccggacagttcagcaaccagatcctcaagcacgccaccgtcgtctgcaagccgctcgaggcctagaattttctatttgatcgtatggaggcttctgacatgcgtgtctgtgcatgcatgcgtgaacgctggtgccgggagatcgatctatgcacgcatgtgatgtgtattttcctttttttgtgcttttattttacttagttgcatttttgttggtcttcatgtgaggcgtcatgttgtagatttactatgttggtgataatgatgtaaaacttcttcaaaaaaaaaa

SEQ ID NO: 145 - DNA, 1358 bp, Lolium perenne
cctcaccagcacctctctcgcccacgcctccgatctcctctcgccgccgcgctcggtgccaagagaatgggcagcgtcgacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgcttcaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgcctcctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatgatcaacttggcaacgacgagcgaacctacattgagcgcgacaatttccgtgacatatactcctcaacttggttcaatacatgattgtgaactgtgtgaatgtgtttccgtcttctatcagagattcagagtgtgcatgttagtttcaataggaagaaatgtttggtatgagtccggcctaataataacggatttgctaaaaaaaaaa

SEQ ID NO: 146 - DNA, 1051 bp, Lolium perenne
caatcatccagcccagatctcacgcgtttccttcctccagctaaagaccggcaatggcgaccacggcggctgatgccacggccacggttgccaaggagcagaccaccaccaacggcgccgccagcggtgccgagcaggtcacccgccactccgaggtcgggcacaagagcctgctccagagcgacgcgctctaccagtacatcctggagaccaccgtgtacccgcgcgagcacgagtgcatgaagcagctccgcgaggacaccgccaaccacccatggaacctgatgaccacgtcggcggacgagggccagttcctcaacctgctcatcaagctcatcggcgccaagaagaccatggagatcggcgtctacaccggctactccctcctcgccaccgcgctcgccatccccgaggacggcacgatcttggccatggacatcaaccgcgagaactacgagaccatcggcaagccgtgcatcgagaaggccggcgtcgcgcacaagatcgacttccgcgaggggcccgcgctcccggtgctcgacgagctgctcgaggacgaggccaaccacggcaccttcgacttcgtcttcgtcgacgccgacaaggacaactacctcaactaccaccagcgcctcatgaagctcgtcagggtcggcggcctcctcggctacgacaacacgctctggaacggatccgtcgtgctccccgccgacgcgcccatgcgcaagtacatccgctactaccgcgacttcgtcctcgagcttaacaaggccctcgccgcagacgaccgcgtcgagatctgccagctccccgtcggcgacggcatcaccctctgccgccgcgccaagtgattgtctgattgatgacgcgagcgcgccgccccctcggctccgctccgctccatggatgcggacaagaattgattaattattattccccattttgccgttctggctttcttctgtatcttcttggaaacaaatattgtccctttatgtacgtatatcaaatttatatccagacaaataatattactcctataaaaaaaaaa

SEQ ID NO: 147 - DNA, 1332 bp, Lolium perenne
gacgaatcctaccaaaccgagctaccagatccttctctactaatcgagctccctccgcctgtcctcgtccccgcctcaccgccggccggttctccgctccgagctatacgtccgtccgagaacacccgtcccatattaactatcaacatgacagtcgtcgaggtcttagctgccggcgacgccgccgccgccgcggtggcgcggcccgccgggaacgggcagaccgtgtgtgtgaccggcgccgccgggtacatcgcgtcctggctcgtcaagctgctgctggagaaggggtacactgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcatccccagtcactgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgcaagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccacaaggtgctccgacgaggcgaacccgaggaagcagccatacaagatgtctaaccagaagctccaggacctcggactcgagttcaggccggtgagccagtccctgtacgagacggtgaagagcctccaggagaagggccaccttccggtgctcagcgagcaggcagaggcggacaaggaaaccctggctgcagagctgcaggcaggggttaccatccgagcatgaggaacaagaaatcaaccatgtccatactgctactgtcatgtaaaccaggcagtgtctgttgaatgcctaatctaagttcttgtaaaaaaaaaa

SEQ ID NO: 148 - DNA, 1236 bp, Festuca arundinacea
caagagctagttcttctgtccatccgtagctcttccctttcaccaacaagctagtttagacaagtacagtggtactgtaagagcaacaatgaccgttgtcgacgccgccgcgccgcagctgcctggccatgggcagaccgtgtgcgtcaccggcgccgcggggtacatcgcgtcggggctcgtcaagctgctcctggagagaggctacaccgtgaagggcacagtgaggaacccagatgatcccaagaacgcccacctgaaggcgctggacggcgccaccgagaggctgatcctctgcaaagccgacctcctcgactacgacgccatatgcgccgccgtcgagggctgccacggcgtgttccacaccgcctctccagtcaccgatgatcctgagcagatggtggagccggcggtgcggggcacggagtacgtgatcaacgcggcagcggatgcgggaacggtgcgccgggtggtgttcacgtcgtcaatcggtgccatcaccatggaccccaaccgcggtcctgacgtagtcgtcaatgagtcctgctggagcgacctcgaattctgcaagaaaaccaagaactggtactgctacggcaaggccgtggcggagcaggctgcgtgggaggcggccaggaagcgcggcatcgacctcgtcgtcgtgaaccctgtgctcgtggtagggccgctgctgcaaccaacggtgaacgctagcgccgcacacatcctcaagtacctcgacggctcggccaagaagtacgccaacgctgtgcagtcatacgtagacgtgcgtgacgtagccggcgcgcacatccgggtgttcgaggcgcctgaggcgtcgggccggtacctctgcgccgagcgcgtgctgcaccgtggggacgttgtccaaatcctcagcaaactcttccctgagtaccctgtgccaacaaggtgctctgatgaagtgaacccacggaagcagccttataagatgtccaaccagaagctgcaggatcttggcctccagttcactcctgtgaacgactctctgtatgagaccgtgaagagcctccaggagaagggacatctcctagtaccaagcaaaccagagggattaaacggtgtaacggcatgatactgctaaagaagcagcagagttcacgtgctcctgtaacatggtcaaacatgagttgtttttctgtataaattctatccagtatcgtgttatttaagtgaactaagagaaaaaaaaaa

SEQ ID NO: 149 - DNA, 1428 bp, Festuca arundinacea
ctctcgatcggcagacgcagagatcgatgggttccaccgccgccgacatggccgcgtccgccgacgaggaggcgtgcatgttcgccctccagctcgcctcctcgtcgatcctcccgatgacgctgaagaacgccatcgagcttggcctcctggagatcctggtggccgccggcggcaagtcgctgacccccaccgaggtggccgccaagctcccgtccgcggcgaacccggaagcgccggacatggtggaccgcatgctccggctgctcgcgtcgtacaacgtcgtgacgtgcctggtagaggagggcaaggacgggcgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatccccttcaacaaggcgtacggcatgtcggcgttcgagtaccacggcacggacccgcgcttcaaccgcgttttcaacgaagggatgaagaaccactccatcatcatcaccaagaagctcctcgagctctaccacggcttccagggcctcggcaccctcgtcgacgtcggcggcggcgtcggcgccaccgtggccgccatcgccgcccactaccccgccatcaagggggtcaacttcgacctcccccacgtcatctccgaggcgccgcagttcccgggcgtcacccacgtcggcggcgacatgttcaaggaggtgccctcgggcgacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaagcccagctcgcagggggtcttccacgtcgacatgatcatgctcgcgcacaaccccggcggcagggagaggtacgagagggagttcgaggccctggccaggggagctgggttcaccggcgtcaagtccacgtacatctacgcaaacgcgtgggccatcgagttcaccaagtagatgagatccctccggcctccatgcatccaggcaacctcccaccgatatgagaacgatcgtcgtcgatcttgctggctgctgcctctgctcctgcatcgatctgcatacgtaccctttgcttggtttttcctctgttttccctaattttctcatgctctgaattctgaattctgatggctgtgtcgtcgatctgctcggaaatgttctgaaaaggttgcgtatgttgtatacttgtatgtgatgtaatgagatgatttctctcctttgttgaatactcgagtaaattgaagtgactctcatcttcctctgaaaaaaaaaa

SEQ ID NO: 150 - DNA, 1455 bp, Lolium perenne
ctctcgctcacaccaaaatcgcccaccagcaccagcatctctcgatcggcagacgcatagatcgatgggctccaccgccgccgacatggccgcgtccgccgacgaggacgcgtgcatgttcgccctccagctcgcttcctcgtcggtcctcccgatgacgctgaagaacgccatcgagcttggcctcctggagatcctggtggccgccggcggcaagtcgctgaccccgaccgaggtggccgccaagctcccgtccgcggcgaacccggaagcgccggacatggtggaccgcatactccggctgctcgcgtcgtacaacgtcgtgacgtgcctggtggaggagggcaaggacggccgcctctcccggagctacggcgccgcgcccgtgtgcaagttcctcacccccaacgaggacggcgtctccatggcggcgctcgcgctcatgaaccaggacaaggtcctcatggagagctggtactacctcaaggacgcggtccttgacggcggcatcccgttcaacaaggcctacggcatgtcggcgttcgagtaccacggcacggacccgcgcttcaaccgcgtcttcaacgaagggatgaagaaccactccatcatcatcaccaagaagctcctcgagctctaccacggcttcgagggtctcggcagcctcgtcgacgtcggcggcggcgtcggcgccaccgtggccgccatagccgcccactaccccaccatcaagggggtcaacttcgacctcccccacgtcatctccgaggcgccgcagttcccgggcgtcacccacgtcggtggcgacatgttcaaggaggtgccctcgggagacgccatcctcatgaagtggatcctccacgactggagcgaccagcactgcgccacgctgctcaagaactgctacgacgcgctgccggcgcacggcaaggtcgtgctcgtcgagtgcatcctgccggtcaacccggaggccaatcccagctcgcagggggtcttccacgtcgacatgatcatgctcgcgcacaaccccggcggcagggagaggtacgagagggagttccaggctctcgccaggggagccggattcaccggcgtcaagtccacgtacatctacgccaacgcgtgggccatcgagttcaccaagtagatgagatccctccaagcatccaggcaacatgtcccaccgatatgagaacgatcgtcgtcgatcttgctggctgctgccgctgctcctgcatcgatcaccctttgcttggtttttcctctgttttccctaattttctcatgctctaaatccattctgaattttaatggttgtgtcgccgatctgctcggaatgtaccattaataacgatgttctgaaaaggttgcgtatgttgtatacttgtatgtgatgtaatgagatgatttctctcctttgttgaatatacgagtaaattgaagtgaaaaaaaaaa

SEQ ID NO: 151 - DNA, 2101 bp, Lolium perenne
catcaacctaaaacccacgcgatccaacaccccctagagaaaaacaaaaacaaaaagattacagtttctggtttgagtatcaatcgatggtgggcttcgctaagatcgccatggagtggatccaagatccactgagctggctgttcatcgcctccgtggttttcgtggttctgcagcggcggcggcggggcaacgtggcgccgtttcccccgggcccgaaaccgctgccgatcgtcggcaacatgtcgatgatggaccagctcacccaccgtggcctggcggcgctagcgaaggagtacggcggccttctccacatccggctcggtaagctccacacctttgccgtgtcgacgccagagtatgcccgggaggtgctgcaggtgcaggacggtgccttctcgaaccgtcccgcgaccatcgccatcgcgtacctcacctacgaccgagccgacatggcgttcgcgcactacgggcccttctggcgccagatgcgcaagctgtgcgtgatgaagctcttcagccggcgccgcccggagacgtggctcgccgtgcgcgacgagtccgcggctctcgtccgcgccgtggccaggcggaccggcgagtccgtggacctcggcgagctcatttttaaactcaccaagaatgtcatcttccgcgccgcgttcggagctggtgcggtcgccgccgacgccgaggagggcgacggagcagggaagcaggacgagttcatcgccatcctccaggagttctccaagctcttcggcgccttcaacatcggagacttcatcccgtggctgagctgggcggacccgcagggcatcaacgtgcgcctccgcgccgcgcgcaacgccctcgacgagttcatcgacaagatcatcgacgagcacatggagaggggcaagaatcccgatgatgccgatgccgacatggtggacgacatgctcgcgttcctcccggaggcgaagccgaagaagggcgccgccggcgacggcgtggacgacctgcagaacacgctccgcctcacccgcgacaacatcaaggccattatcatggacgtgatgtttggcgggacggagacggtggcgtcggcgatcgagtgggcgatggcggagatgatgcacagccccgacgacctccgccgcctgcagcaggagctcgtcgacgtggtggggctcgaccggaacgtggacgagtcggacctcgacaagctccccttcctcaagtgcgtcatcaaggagacgctccggctgcacccgcccatcccgctgctcctccacgagaccgccgaggactgcgtcgtcggcggctactccgtgccccggggctcccgcgtcatgatcaacgtctacgccatcggccgcgaccgcagggcgtggaaggacgccgacgtgttccggccgtcgcggttcgtgcagggggaaggggaggccgccgggctcgacttcaaggggggatgcttcgagttcctgcccttcgggtcaggccgccgctcctgccctggcatggcgctcggcctgtacgcgctggagctcgccgtggcgcagctcgcgcacggtttcagctgggagctgcccgacgggatgaagccgtcggagctggacatgagcgacgtcttcggcctcaccgccccgcgcgccaccaggctcttcgccgtgcccacgccccgcctcgcatgcacccagctgctgggagctgacgacgccgggcgccaggcgtgacggccattgctgtgttagcaagcgatcgatggtatatgtaccagctggccggaagatgaaggtgtttgatatattcagaggtgatggcggaggcgccattggtggagcttggtggttttatcttgctttttttttactatttttcttatactttgaactcaattaagtctggtgacaacagaacacaataagcggattatcatgcttgctggatgcatgcttggatacagtgttaagcatgatgtgttctaccatgaagaacgcaaattgtaaaaacaagtttttagacctgctgcaccgagattctgtattttcttcctcttggttttccatcgtgagtactatattaatgccaggatgatagttccagttgaaaaaaaaaa

SEQ ID NO: 152 - DNA, 2460 bp, Lolium perenne
gttctttgcaacgatcaacactgtcagaatccagatacacacacacacacacacacaccaagcagcgtctagctagcttacttgctctagtagttctttgcaaatatccatggagtccgagaacgttgccgccaacggcgatggcctgtgcgtggcacagccggctcgcgccgaccctctgaactggggaaaagcagccgaggagctgtctgggagccatcttgatgccgtgaagcgaatggtggaggagtaccgccgccctgtggtgaccatggaaggcgccagcctgactatcgccatggtcgctgcggtggctgccggcgccgacaccagggtggagctcgacgagtccgcccgcggacgcgtcaaggagagcagcgactgggtcatgaacagcatggccaacggcaccgacagctacggtgtcaccaccggcttcggtgccacctcccaccggaggaccaaggagggtggcgctctccagagagagctcatcaggtttctcaatgcgggagcattcggcaccggcagcgatggccacgtcctgcccgctgcgacgacgagggctgccatgcttgtccgtgtcaacaccctgctccagggctactctggtatccgctttgagatcctcgagacggtcgccacgcttctcaacgccaacgtgacaccgtgcctaccgctccggggcacgatcacggcatccggtgacctcgttccgctgtcctacatcgcgggccttgtgaccggccgcccaaattctgtggcgactgctccggatggcacgaaggttaacgctgcagaggcattcaaaatcgcgggcatccagcacggtttctttgagctgcagcctaaggaaggccttgccatggtcaacggcaccgcggtgggctccggactggcgtccatggtgctcttcgaggctaacatccttggcatcctcgctgaggttctgtcggctgtgttctgtgaggtcatgaacggcaagccagagtacaccgaccacctcacgcacaagttgaagcaccaccctggtcagattgaggccgcggctatcatggagcacatccttgaaggaagctcctacatgatgctcgcgaagaagctcggcgagctcgacccactgatgaagccgaagcaagataggtatgcccttcgaacatcaccgcaatggctgggccctcagattgaggttatccgtgccgccaccaagtccatcgagcgcgagatcaactccgtcaacgacaacccgctcatcgacgtctctcgaggcaaggccatccatggtggcaacttccagggcacacccatcggtgtgtccatggataacaccaggcttgccattgctgcgatcggcaagctcatgtttgcccagttctctgagctagtgaacgacttctacaacaatggtttgccttccaatctctcgggtgggcgcaacccgagcttggactatggcttcaagggtgctgagattgccatggcctcctattgctccgagctccaattcttgggcaaccctgtgactaaccatgtgcagagtgcggagcagcacaaccaagacgtcaactctcttggtctcatctctgctaggaagacctctgaggccatcgatattctgaagctcatgtcatcgacattcttggttgcactgtgccaagctatcgacctccgccacctcgaggagaatgtcaagaatgccgtcaagaactgtgtgaagatggtggctaggaagaccctgagcaccaatgacagtggccatctccacagcgcacgcttctgcgagaaggacctgctcttgacgatcgaccgcgaggcggtgttcgcctacgcagacgacccttgcagcgctaactacccactgatgcagaagatgcgtgcagttctcgtggagcacgccttggccaacggtgaggctgagcgggatgtgcagacgtcagtgttcgccaagcttgccgcattcgagcaggagctccgtgcagtgcttccaagggaggtcgagtcagcccggtgtgctgtggagaatggcaccgccgcgcagcaaaaccgcatcaccgaatgccggtcgtacccgctgtaccgcttcgtgcgcaaggagctcggaaccgagtacttgaccggagagaagacgaggtctcctggtgaagaggtggacaaggtgtttgtggctatgaaccaggggaaacacatcgacgcactgcttgagtgcctcaaggagtggaacggtgagcccctgcctatctgctgaagaatgaatcaaggaactgaagaatagagtacttgagagttcagaaggctccacatgtgcttagttaatagtaagtatagtactgttttttcattgtatcttgtgcattatatatacatgtaacactggaataaaatttcaaaaaatcagatcactcaatgggcagcatgtaacactggaataaaaatttcaaaaaaatcagatcaaaaaaaaaa

SEQ ID NO: 153 - DNA, 2595 bp, Festuca arundinacea
ctcctctgtaattcgagctcctcttcagcacaagtacttccaccagagtgccagacaacaatccagcaccacttccagaatacatacacacacgtacccgtgtctaaaccttacttgctttcctagttctttgcatatctccatggagtgcgagaacgggcacgttgccgccaacggcgatggcctctgcgtggcgcagccagcccgggccgaccctctcaactgggggaaggcagcagaggagctgtccgggagccatttggatgccgtgaagcggatggtcgaagagtaccgcagaccagtcgtgaccatggagggcgccagcttgaccattgctatggtcgccgcggtggccgccggcgccgacacccgggtggagctcgacgagtccgcccgcggacgcgtcaaggagagcagcgactgggtcatgaacagcatggcgaacggtaccgacagctatggtgtcaccaccggcttcggcgccacctcacaccggaggaccaaggagggtggcgctctgcagagagagctcatcaggttccttaacgcgggagcatttggcaccggcagcgatggccatgttttgcccgctgcaacaaccagggcggccatgctcgtccgtgtcaacactctgctccaggggtactctggcatccgcttcgaaattctcgagacgatcgccacgcttctcaatgccaacgtgacgccgtgcctaccgctccggggcacaatcacggcatccggcgacctcgtcccattatcctacatcgccggccttgtgactggccgcccaaactctgtggcgacagctccagatggcagcaaggttaacgcagcagaggctttcaagattgccggcatccagcatggcttctttgagctgcagcccaaggaaggccttgccatggtcaacggcactgccgtgggctccgggctcgcgtccatagtgcttttcgaagctaacatccttggcatccttgccgaggttctatcggccgtgttctgcgaggtgatgaatggcaagccggagtacaccgaccacctaacacacaagctgaagcaccacccgggccagatcgaggccgcggccatcatggagcacatccttgaaggcagctcctacatgatgctcgcgaagaagctcggtgagctcgacccactgatgaagccaaaacaagataggtatgcactccgcacatcaccacaatggctcggccctcagatcgaggtcatccgtgctgctaccaagtccatcgagcgtgagatcaactccgtcaacgacaacccactcatcgacgtctcccgcggcaaggctatccacggtggcaacttccagggcacgcccatcggtgtgtccatggacaacaccaggcttgccattgcggccatcggcaagctcatgtttgcccagttctcggagcttgtgaacgatttctacaacaacggtttgccttccaatctctctggtgggcgcaatccgagcttggactatggcttcaagggtgctgagattgctatggcctcatactgctccgagctccagttcttgggcaaccctgtgactaaccatgtgcagagcgccgagcagcacaatcaagacgtcaactctctcggcctcatctcttccaggaagaccgctgaggcgattgacattttgaagctcatgtcctcgacattcatggttgccttgtgccaagctatcgacctccgccacatcgaggagaatgtcaagaatgccgtcaagaactgtgtgaagacggtggctaggaagaccctgagcaccaatgacagtgggcatctccacaatgcacgcttctgcgagaaggacctgctcctgacgatcgaccgtgaggcggtgttcgcctacgcagatgacccttgcagcgccaactacccgctgatgcagaagatgcgtgcggttctcgtggagcatgccttggccaacggtgaagccgagcaggacgtgcagacgtcagtgttcgccaagcttgccacattcgagcaagagctccgtgcggttcttcccaaggaggtcgagtctgcccggtgttccgtggagaacggcaccgccgcacagcagaaccgcatcagcgaatgccggtcatacccgctctatcgcttcgtgcgcaaggagctcgggactgagtatttgaccggagagaagacgaggtctcctggtgaagaggtggacaaggtgtttgttgctatgaaccagggtaagcacattgacgcgctgcttgagtgcctcaaggagtggaacggtgagcccctgcctatctgctgaagaatggctcaaggaactcaagaatagagtgcttgagaattcagatggtactgttttataattatatctccggatatcgatgtttgcaatgttcctccagagctgcaatgccagttagaaaagataatagcatgacttggtagtgttgtttagcctagaaattttctatgatgttagttagtaaaagggtacactttgtgataaatatacataattattgcactagtcctttatttttatatcaatgttctgtctactgaggcaactttgaaggattcaaagaatctagtattggcctgccaaaaaaaaaa

SEQ ID NO: 154 - DNA, 1382 bp, Lolium perenne
ggccacaactcgccacatctggcatagcgagcactgacagtgagctacatccatcaccatggcttctagccgtgtcctgctcctcgtcgtggcagctctggcgatctccgtgtccgccacggccgcggccaccaagatcagtgctccactaccgccgctggccaagggcctgaacttcgatttctacaaggccacctgcccgcaggccgagtccatcgtcttcaacttcctccgcgacgccatccgcaaggacgtcggcctcgccgccgcgctcctccgcatccacttccacgactgcttcgtgcagggctgcgacggctccgtgctcctcgacaagaccggcggcaccgacagcgagaagatcgcaccacccaacgtcacgctccgccccaccgccttcaaggccatcaacgacctccgcgctctcctcgccaaggcctgcggcgccgtcgtctcctgcgccgacatcgccgccctggccgcgcgcgactccgtgcacctcgccggcgggccgcactaccccgtcccgctcggccgccgcgacgggctcgcccccgcgaacctcaccaccatcctcaacgccctcccggcaccgagctccaacgtcaccaccctcctcagattcctcgccaagatcagcctcgacgccaacgacctcgtcgcgctatccggcgcgcacacgctcggcatcgcgcactgcacctccttccaggagcgcctcttcccgcagaacgacgtcaccctcaacaagtggttcgcgtcgcagctcaggctcacctgcccggcgctcaacaccgacaacaccaccaacaacgacatccgcacccccaacgtcttcgacaacaagtactacgtcgacctgctcaaccgccagggactcttcacctccgaccaggacctgcacaccgacgccaggaccaagcccaccgtcaccaggttcgccgtcgaccaggccgcctttttcgaccagttcgtcttctccgtcgtcaagatgggccagatcaacgtgctcaccggcagccagggacagatacgcaacgactgctccgcgcccaacaaaggccgcaccaacgacgacctgccgtggtccgtgctcgagaccgtcaccgaggccgcccagagcttggtgttgtagatatgcgctgtggataggttggttcagtcgatccatctctagcctacgtactttcttcccaaagttgtagctttattagcgagccgtgtggtaatggtttgggctttgagagccacagttgatgcatgtgtgtttagtttcttgagcaactcgaccagtttaataatcacgagatggtttttggtgtgtcgaatgacgactagaaaattgagatgaatatttgatgttattttcaataaaaaaaaaa

SEQ ID NO: 155 - DNA, 1260 bp, Lolium perenne
atcgcctttctcctccatgaccaccatgggcggctcgtcgatcctgcccgcgccgaccgtggcgacgacggcgctggttctgctgatcgtgctgttcgcatcgccggcaacggtggcgaaaggttctgggctgtccgtcgggttctacaagaagttgtgtccgaaggcggagaaggtcgtccggcgaactgtcaccaaggcctttgagaaggagcctggcaccccggccgacatcatccgcctcttctttcacgactgctttgtccgagggtgcgacgcatcggtgctgctggaatccacgccagggcgcatggcggagagggactcgaaggcaaacaaccccagcttggatgggtttgaggtcattagcgacgccaaggagacccttgagaagctctgcccgcaaaccgtctcctgtgctgacattctcgccctcgccgcccgcgatggcgcctacctcgctagcgggctcgactatgcggtgcccaccggccgccgtgatggcctcgtctccaaggaagacgaggttctccctagtgtccctcaccccgacttcaaccattctcagctcgtggaaaacttcacggcaaaaggctttacggcggaggagatggtgacgctgtcgggggcgcacaccatcggcacctcgcactgctcgtccttcacggaccgcctctacaacttctcccagggcggcgcgctgaccacggaccctgcgctgccggcggcatacgccgcgctgctgaaggagaagtgcccgccggagacagcggcgcagaacgacaccaccatggtgcagctcgacgacgtgacgccgttcgtgatggacaaccagtactacaagaacctgcttgccggcaccgtgccgctcggctccgacgtagcgctcatggagagccccgacacggcggcgctcgtcgagctctacgcccgcgagcccgccgagtactgggccaagcgcttcgttgcggcgatggtcaaggtgagcgagatggaggtgctcaccggggccgagggggagatccggctcaactgctccaaggtgaactagtatataaccggttgctgcgtttgtctctgtactatatgtttgggaaagatgacgatacacgttcttcttttgtgttaatgttttttctttcatttgttttcatatggtggtgagaaatatatacacatttgtttgcgtcataaactgtatagcttacacagcatgcataaaagcatctatatcattccatttgagttgtaaaaaaaaaa

SEQ ID NO: 156 - DNA, 1204 bp, Lolium perenne
atccccaaacccaaaaggtgaggcctccagatacttggatctccaatggctcctgctactcccaaggacagctctgctctgcctggtttgctcttgctcttcgcagcagcgacgtccgtggcggtagcgaacgcacagctatcagagaactactacgggtcttcttgtcccaccgcgcttctcaccatcaggactgtcgtgacgacggcggtgctgctggaccaccgcatgggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaaaaaaaaa

SEQ ID NO: 157 - DNA, 1530 bp, Lolium perenne
actcattcatctgtcgtctcctgcttccctcaagcttagatcgattgcagccggccggggactgttgagctaccactgccggtcgctggtacgagcggacgtaaggagagatccagatggccgcgacgatgaccgtggaggaggtgaggaaggcacagcgggcggaggggccggcgacggtgctggccatcggcacggcgacgcccgctaactgtgtctaccaggctgactacccggactactacttcaagatcaccaagagcgaccacctcgccgatctcaaggagaagttcaagaggatgtgcgacaagtctcagatcaggaagaggtacatgcacctgacggaggagatcctggaggagaaccccaacatgtgcgcgtacatggcgccgtcgctggacgcgcgccaggacatagttgtcgtcgaggtcccgaagctcgggaaggcggcggcacagaaggcgatcaaggagtggggccagccgcggtccaagatcacccacctcgtcttctgcactacctctggtgtggacatgccaggcgccgactaccagctcaccaagatgctcggcctgcgcccgtcggtgaagcgcctcatgatgtaccagcagggctgcttcgccggcggcacggtgctccgcctcgccaaggacctggctgaaaacaaccgcggcgcgcgcgtgctggtggtctgctcggagatcacggccgtgaccttccgcggcccgcacgagtcacacctcgactcgctggtcggccaggcgctcttcggggacggcgctgccgcggtgataatcggcgccgaccccgacgtgtccgtcgagcgcccgctgttccagctggtgtcggcgagccagaccatcctgccggactcggagggcgccatcgacggccacctcagggaggtcggcctcaccttccacctcctcaaggacgtgcccgggctcatctccaagaacatcgagcgcgccctggaggaagccttcaagccgctcggcatcgacgactggaactccgtcttttgggtggcgcacccgggcgggccggcgatcctcgacatggtggaggcaaaggtaaacctcaacaaggagcggatgcgtgccaccaggcacgtcctctccgagtacggcaacatgtccagcgcatgcgtcctcttcatcatggacgagatgcgcaagcgctctgccgaggatggtcacaccaccaccggcgagggaatggattggggcgtcctctttggcttcgggcccggcctcaccgtcgagaccgttgtcctccacagcatgcccattgccgctgatgccaccgcttgatcgatggttccatctccgtttatctgccacatcgatggatacctactactactaccgccgccgccgctgctatccaaagtaatttgtattgtattcatgcatacctggtttgtatttgttggtaggattcgttccgctattatgtcgcttgtgtcgcgtacactgttgtatcctagtaatagtaatcaaacggagtacggtttatgtaaaaaaaaaa

SEQ ID NO: 158 - DNA, 1418 bp, Festuca arundinacea
gaaaagacagcacagaaatctatattctacaaggcagaaaagagcagcaggggaaatctagctaaggtcttgagaggaagatgaagcaggaggtgaagagcgagatgaacggcgagacgatgagcggcaacaaagggccggtggtggtgaccggggcgtcgggtttcgtcgggtcatggctcgtcatgaagctccttcaggcggggtacaccgtccgggccaccgtgcgcgaccctgggaacgtcgagaagacgaagccattgctggagcttcccggagccaaggagcggctgtccatctggcgtgccgacctgagcgaggaaggcagcttcgacgaggccatcgcgggctgcaccggcgtcttccacgtcgccacgcccatggacttcgagtccaaggaccctgagaacgaagtgatcaagccgacggtggaagggatgctgagcatcatgagagcgtgcaaggaggccggcaccgtcaagcgcgtcgtcttcacctcctccgccggcaccgtcaacattgaggagcggccgaggccggcctacgaccaggacaactggagcgacatcgacttctgccgccgcgtcaagatgacaggacagatgtacttcgtgtccaagtccctggcggagaaggccgccatggactacgccaaggagaacggcgtggacttcatcagcatcatccccacgctcgtcgtcggccccttcctcagcgccggcatgccgcccagcctggtcaccgccctggcactcatcacggggaacgaggcccactactcgatcctgaagcaggtgcagctggtccacctggacgacctctgcgactccatgacctacctcttcgagcacccggacgccaacggccgctacatctgctcctcccacgacaccaccattcatggcatcgccaggatgctcaaggagaggttccccgagtacgacatcccacagaaattcccgggagtcgacgacgacctccagccgatccacttcttcttcaagaagctgctcgaccacgggttcaggttcaggtacaccgccgaggacatgttcgacgccgcggtctggacgtgcagggagaagggcctgattccgctcggagcggaaggggcaggcggcccggccagtgcagccggcaagctgggagctgttctcgtgggcgaaggtcaggcgattggtgctgagacataagcgctagtgcatgtacactaggctggctacctcagacacatggtggagcgatgattatgttcgttaattctactatcctatatttcggttcagaaattgcattaagagaaccctgtaattggtgggatattatgaacggattatggaacgcaaataacttcatgacaaaaaaaaaaaaaaaaaaaaaaaaaaaaaaaaaaaaaaaaaaaaaaaaaaaaaaaaaaa

SEQ ID NO: 159 - DNA, 1209 bp, Lolium perenne
gagcaccacacatggcgactgaagccaagggggagacggtgctggtcaccggcgccagcggcttcatcggctcctggctcgtccgcctcctcctcgcccgcggctactccgtccacgccgccgtcctcaaccccgatgacaaggccgagacggaccacctcctcgcgctcgccgctgcggccggcgacgagggccgcatccgcttcttcaggtgcgacctcctcgacggcgccgccatgctcgccgccgtgcggggatgctccggcgtgttccacctcgcctctccctgcaccgtcgacctcgtcctcgacccccagaaggagcttgtggtgccggcggtggagggcacgctcaacgtgctgcgcgccgccaaggaagctgggggagtgcggcgggtggtggtgacctcctccgtctccgccctcgtcccctgcccggggtggccggccggcgaggtcctcgacgagcgctgctggaccgacatcgactactgcgacaagaacggggtttggtaccctgcttcaaaggcactggcggagaaggcggcatggaagtttgcagaggagaatggactggatgtggtgacggtcaatccagggacggttttgggcgagatgattccgccaaggctcaatgccagcatggccatgtttcttcgcttacttgaaggttgcaaagaggagtatgcagatttcttcatcgggccagtgcacgtggaagacgttgcattagcccatattctgctgtacgagaatccgtcagcatccgggaggcacctctgcgtggagcccatctgtcactggagtgttttcgcggcgaaagtcgccgagctctaccctgattacaaagttccaaaattccctgaggacacacagcctgggctggtgagggcggaggcggtgccaaagaagctgatggcgttgggtttgcagttcactcctcttgagaagatcatcagggatgccgtggagagcctcaagagcagaggatgcatcgcctgatgattggatcgttaggcatgtcacccttccgtcgtaggttcatgatcatccttgttgagagatgtgttgtgttgtgtccagcccagtgcctacccagaccatatacttaccagtatgatttgtgcaataacagccggttgatgtacggcatcacctgccctacacttgggatgcggatgctgtcacactgactccctcaaaaaaaaaa

SEQ ID NO: 160 - DNA, 1260 bp, Lolium perenne
gaaaagcttcacacagcttgagaaaatggtgagctcaaccaagggcaaagtgtgtgtaactggggcttcaggctttgttgcctcttggctcatcaagaaactccttgagtctggatatcatgtgatagggactgtcagagacccagggaatcgaagaaaggtgggacacctttggaaactaccaggtgcaaatgagaggctccaacttgtgagagctgatctattggaggaagggagctttgacgatgctgtaagggcttgtgagggtgtcttccacattgcgtcgcctgtccttgggaaatctgattccaattgcaaggaagcaacactcggtcctgcaatcaatggtaccctcaacgtgctaagatcctgcaagaagagtccatttctcaaaagggttgttctcacatcttcatcatccgcggtaaggattagggatgaaactcagcagccagaactgttatgggatgaaacgacatggagctctgtgccactctgtgaaaagctacagctatggtatgccctggcaaaggtatttgcagagaaagcagcattggactttgccaaggagaataacattgaccttgtgacagttcttccatcattcgtaattggacccagtttatcccatgaattgtgcactactgcttcagatatccttggcttacttcaaggtgacacagacaggttcactttgtacggaaggatgggatatgttcacatcgatgatgttgcccggagccacattctagtgtacgaaacaccggaggcaactggcagatatctgtgcagctcagtggttctggataacaatgaattggttggcttactggcaaaacagtttccagtattccccattccaaggaggctcaagaacccctatggaaagcaggcataccagctagacacatccaagctccaggggctgggtctcaagttcaaaggagtgcaggagatgtttaacgactgcgtcgaatcgctgaaagatcagggccatttgctggagtgcccgttgtgataacagagacagcattgacaagccatagccaaacagcattgacaagccatagccaaacacatctcaactatgcctgaatcatgtcagttctcgagtcatagattttttttttctcttcaaataattcccatgtactctccttactataccgaacatcaattgtcagcggcagattaaatgtgtccatatgctttgcaattgtttcaattagtaatgaaatatttgaaacaaaaaaaaaaaaa

SEQ ID NO: 161 - DNA, 1438 bp, Lolium perenne
aaacgactccaacgcaccgatcgacgacacaccctgcacttcacgggtcgatcggatcggaggatggcgccggtggtggagagagcgcccttcctgccgacgggggaggccacgctgcggccgtccttcgtgcgggacgaggacgagcggcccaaggtggcgcacgaccgcttcagcgacgaggtgcccgtcatctcgctccacggcatcgacgacgcgcggaggaccgagatccgggaccgcgtggcggcggcgtgcgaggggtggggcatcttccaggtcgtcgaccacggcgtcgacgccgcgctcatcgccgagatggccaggctctcgcgcgacttcttcgcgctccccgccgaggacaagctccgctacgacatgtccggcggcaagaagggcggattcatcgtctccagccacctccagggcgagacggtccaggactggcgggagatcgtgacctacttctcgtacccggtcaaggcgcgggactacggccggtggccggacaagcccgcggggtggcgcgcggtggtggagcagtacagcgagcggctcatggcgctgtcctgcaagctgctgggggtgctgtcggaggccatgggcctggagacggaggccctgtccaaggcgtgcgtggacatggaccagaaggtggtggtcaacttctaccccaagtgcccccagcccgacctcaccctcggcctcaagcgccacaccgaccccggcaccatcaccctcctcctccaggacctcgtcggcggactccaggccacccgcgacggcggcaacacctggatcaccgtacagcccatcgccggcgcattcgtcgtcaacctcggcgaccacggccactacttgagcaacgggaggtttaagaacgcggaccaccaggcggtggtgaacggggagagcagcaggctgtccatcgccacgttccagaacccggcgcccgacgccaaggtgtggccgctggcggtgagggagggggaggacaccatcctggaggagcccatcaccttcaccgagatgtaccgccgcaagatggcgcgcgacctcgagctcgccaagcgcaagaagcaggccaaggccgatcagctcaagcagcagctgcagcaggaggccgcgcccgccgccgcgcccaccaagccactcaaccagattcttgcctagattccatgccgattcattcatgcgtgatatatagtactatgtactatatcgtattaaaataagtaattatctctatctactcatttgtgtgtaattaagagatgagtaattatctagtatatacacatttgtctgcgaggagcgagctggacctgtaataacatgtagcatgtcctacgtggaaccgatcagctgattggagctgtcacatgagtttgctgtgtgcagaaattgaacgcattcggtactgctttcaaaaaaaaaa

SEQ ID NO: 162 - DNA, 1214 bp, Lolium perenne
gaaaatccccaaacccaaaaggtgaggcctccagatacttggatctccaatggctcctgctactcccaaggacagctctagctctgctctgcctggtttgctcttgctcctcgcagcagcgacgtccgtggcggtagcgaacgcacagctatcagagaactactacgggtcttcttgtcccaccgcgcttctcaccatcaggactgtcgtgacgacggcggtgctgctggaccaccgcatgggcgcttctcttctccggctccacttccacgactgctttgtgcaagggtgcgacgcgtccgttctgctggatgacacggccggcttcaccggcgagaagggggccgggccgaacgccgggtcgctgcgcggtctggaggtgatcgacaagatcaagatgctgctggagttcatgtgcccgcggaccgtctcctgcgccgacatcctcgccgtcgccgcccgcgactccgtcgtccgtctaggggggccatcatgggcggttcaacttggaaggagggacgccaccacagcaagcgcgtcacttgctagtagtgacctcccaggccccaactccaacctcaatgatctcctcaccgctttctccaaaaaaggactaagcaccacggacatggttgctctatcaggggcccataccatcggccgggcgcagtgccagaactaccggaaccggatctacaccgacaccgacattgacggggcattcgcagcgtccctgcgaggcggctgcccacaggccggcggcgacggcaacctcgcgccgctcgacgcgtcctctcccaacaccttcgataacggctacttctccggcctcctctcccgccaggggctgctccattccgaccaggcgctgtacgacggcggctccacggacgatctggtcaggacctacgcctccaataacgatcagtttggcagcgacttcgctgcggcgatggtgaaactgagcaatatcggcctgctgacggggtcgtccggggagatcagggtcaactgccgggcggtgaattaacgatggatggatgggggcatcatgaaacgaacaaggcgtgcgatttccggaactgcaggcaacgaaactgcatatttatgtacactgcctatttatttcctgtccttgtgtccccgtcttgttatattacatccataatccatgttaagatggtggcattggtttaaaaaaaaaaaaaaaaaaa

SEQ ID NO: 163 - protein, 654 aa, Lolium perenne
MESSAVVPGTTAPLLPYAYAPLPSSSDDARENRSSGGVRWRACAAVLAASALAVVVVVGLLAGGRVDRVPAGADVASATVPAVPMEFPRSRGKDLGVSEKSSGAYSADGGFPWSNAMLQWQRTGFHFQPEQHYMNDPNGPVYYGGWYHLFYQHNPKGDSWGNIAWAHAVSKDMVNWRHLPLAMVPDQWYDSNGVLTGSITVLPDGQVILLYTGNTDTLAQVQCLATPADPSDPLLREWIKHPANPILFPPPGIGLKDFRDPLTAWFDHSDHTWRTVIGSKDDDGHAGIILSYKTKDFVNYELMPGNMHRGPDGTGMYECIDLYPVGGNSSEMLGGDDSPDVLFVLKESSDDERHDYYALGRFDAVANVWTPIDRDLDLGIGLRYDWGKYYASKSFYDQKKNRRIVWAYIGETDSEQADITKGWANLMTIPRTVELDRKTRTNLIQWPVEEVDTLRRNSTDLGRITVNAGSVIRLPLHQGAQLDIEASFQLNSSDVDAINEADVGYNCSTSGAAVRGALGPFGLLVLANGRTEQTAVYFYVSKGVDGGLQTHFCHDESRSTRAKDVVNRMIGSIVPVLDGETFSVRVLVDHSIVQSFAMGGRITATSRAYPTEAIYAAAGVYLFNNATGATVTAERLVVHEMASADNHIFTNDDL

SEQ ID NO: 164 - protein, 620 aa, Festuca arundinacea
MESRAFPNAAYAPLLPPTADDATLGKQDRPGVGWRGFLTVLAASGVVVLLVAATMLAGSRMGQAGDTDEDGAGGFPWSNEMLQWQRAGFHYQPEGHFMSDPDGPVYYRGYYHLFFQYNRRGVAWDDYIEWGHVVSQDLVHWRPLPLALRPDHWYDKKGVLSGTITVLHNGTLVLLYTGVTEDPMAESQCIAVPTDPNDPLLRHWTKHPANPVLAHPQGVQGMDFRDPTSAWFDKSDATWRILIGSKDDDNGSHAGIAFIFKTKDFLSFERVPGIVHRVEGTGMWECIDFYPVGGGHNSSSEELYVIKASMDDERHDYYSLGRYDAAANTWTPLDAELDLGIGLRYDWGKLYAATSFYDPLKQRRIMLGYVGETDSARADVAKGWASLQSIPRTVTLDEKTRTNLLLWPVEEVEALRYNSTDLSGITVDNGSVFHLPLHQATQLDIEASFRLDASDVAAINEADVGYNCSSSGGAAARGAIGPFGLLVHAAGDLRGEQTAVYFYVSRALDGTLRTSFCNDETRSSRARDVTKRVVGSTVPVLHGEALSMRVLVDHSIVQSFAMGGRVTATSRVYPTEAIYARAGVYLFNNATGASVTAERLIVHEMASAVYDETLIMVEDS

SEQ ID NO: 165 - protein, 623 aa, Festuca arundinacea; identical to SEQ ID NO: 66

SEQ ID NO: 166 - protein, 619 aa, Festuca arundinacea
MESRDFPSAAYAPLLPSAADDVALAKQDRPGVGWRGFLTVLAACGVVVLLVAASLLAGSRMGQAGDTDEDGAGGFPWSNEMLQWQRAGFHYQPEGHFMSDPDGPVYYRGYYHLFFQYNRRGVAWDDYIEWGHVVSQDLVHWRPLPLAMRPDHWYDKKGVLSGTITVLHNGTLVLLYTGVTEDPMAESQCIAVPTDPNDPLLRHWTKHPANPVLAHPQGVQGMDFRDPTSAWWDKSDSTWRILIGSKDDDNGSHAGIAFIFKTKDFLSFERVPGIVHRVEGTGMWECIDFYPVGGGHNSSSEELYVIKASMDDERHDYYSLGRYDAAANTWTPLDAELDLGIGLRYDWGKLYASTSFYDPLKQRRIMLGYVGEVDSARADVAKGWASLQSIPRTVALDEKTRTNLLLWPVEEVEALRYNSTDLSGITVENGSIFHLPLHQATQLDIEASFRLDASDVAAINEADVGYNCSSSGGAAARGALGPFGLLVHAAGDLRGEQTAVYFYVSRALDGSLRTSFCNDETRSSRARDVTKRVVGSTVPVLDGEVLAMRVLVDHSIVQSFAMGGRVTATSRVYPTEAIYARAGVYLFNNATGASVTAERLIVHEMASAVYDETVMVKDS

SEQ ID NO: 167 - protein, 1075 aa, Lolium perenne
MAGNDWINSYLEAILDAGGTAGDISAASVAGGDDGPGAGGGTAGEKRDKSSLMLRERGRFNPARYFVEEVISGFDETDLYKTWVRTSAMRSPQERNTRLENMSWRIWNLARKKKQIEGEEASRLSKKRLEREKARRDAAADLSEDLSEGEKGENINGSSVHDESTRGRMPRIGSTDAIEVWANQHKDKKLYIVLISIHGLIRGENMELGRDSDTGGQVKYVVELARALGETPGVYRVDLLTRQISAPDVDWSYGEPTEMLSPRNSENLGDDMGESSGAYIVRIPFGPREKYIPKEQLWPHIQEFVDGALVHIMQMSKVLGEQVGRERRVWPVVIHGHYADAGDSAALLSGALNVPMVFTGHSLGRDKLEQLLKQGRQTRDEVNATYKIMRRIEAEELCLDASEIVITSTRQEIEKQWGLYNGFDVTMERKLRARTKRGVSCYGRYMPRMIAIPPGMEFSHIVPHDVDLDGDEANEVGSGSPDPPIWADIMRFFSNPRKPMILALARPDPKKNITTLVKAFGEHPGLRNLANLTLIMGNRDVIDEMSSTNGAVLTSVLKLIDKYDLYGQVAYPKHHKQSEVPDIYRLAARTKGVFINCAYIEPFGLTLIEAAAYGLPMVATQNGGPVDIHRVLDNGILVDPHNQNDIAEALYKLVSDKHLWAQCRQNGLDNIHRFSWPEHCKNYLSRVGTVKPRHPRWQRSDDATEVSESDSPGDSLRDVHDISLNLKLSLDSEKAGTKINTERNSTNARRNLEDAVLKFSNAVSEGTKDESDENAEATTGSNKWPSLRRRKHIVVIAVDSVQNADLVQIIKNLFEASRKEKSSGAVGFVLSTSRAISETLTFLTSGGIQTTEFDAFICSSGSDLCYPSSSSEDMLSPTELPFMIDLDYHSQIEYRWGGEGLRKTLIRWAAENNSQSGQEVVTEDEECSSTYCISFKVKNTEAVPPVKDLRKTMRIQALRCHVLYSHDGSKLNLIPLLASRSQALRYLYIRWGVELANMTVVVGESGDTDYEGLLGGVHKTIILKGSFNAAPNQLHAARSYSLEDVISFDKPGIASVEGYLPDSLKSALQQFGVLN

SEQ ID NO: 168 - protein, 938 aa, Lolium perenne
MAAGNEWINGYLEAILDAGSKLRPQGVQLPPLETAPALAAEESSAAYNPTRYFVEEVVRSFDEQALHKTWTKVVAMRNSQERSNRLENLCWRIWNVSRQKKQVEWDYTKEVARRKLEQELGSREAAEDLSELSEGEKDTTTAKPDAAAAQPSADDGEHQQPQPRTRLARINSEVRLVSDDEEEQTKKRNLYIVLISIHGLVRGENMELGRDSDTGGQVKYVVELARALAATAGVHRVDLLTRQISCPDVDWTYGEPVEMLERLSSADADDDDGEQAGGGAYIVRLPCGPRDQYIPKEELWPHIPEFVDRALSHVTEVARALGEQLQPPPSPADGAVAAPIWPYVIHGHYADAAEVAANLASALNVPMVMTGHSLGRNKLEQLLKLGRMPGPEIQGTYKIARRIEAEETGLDTAEMVVTSTKQEIEEQWGLYDGFDLMVERKLRVRQRRGVSSLGRYMPRMAVIPPGMDFSFVETQDTADGDGADLQMLIAPDKAKKALPPIWSDVLRFFTNPHKPMILALSRPDPKKNVTTLLKAYGESRQLRELANLTLILGNRDDIEDMAGGGGAVLTAVLKLIDRYDLYGQVAYPKHHKQTDVPHIYRLAAKTKGVFINPALVEPFGLTIIEAAAYGLPVVATKNGGPVDILKALHNGLLVDPHSAEAITGALLSLLAEKSRWVECRRNGLRNIHRFSWPHHCRLYLSHVSTYCDQPSPHQPLRVPLALGSSTSFGADDSLSDSLRGLSLQISVDASSDLNAADSAAAIMDALRRRPASEKPASSGARALGFAPGRRESLLVVAVDCYGDDGKPDVEQLKKAIDAAVSVGECAGAKQGYVLSTGMTIPEAAEAIKACGADVASFDALICSSGAELCYPWKELVADEEYSGHVAFRWPGDHVKSAVPRLGSMEEIALAIDRPASSVHCHAYAATDASKVSITEHYL

SEQ ID NO: 169 - protein, 808 aa, Lolium perenne
MAAKLTRLHSLRERLGATFSSHPNELIALFSKYVHQGKGMLQRHQLLTEFEALFEADKERYAPFEDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNHKGTTMMLNDRIQSLRGLQSALRKAEEYLTSIPEDTPSSEFNHRFQELGLEKGWGDTAKRVQDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTEKGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHPEIEELLYSDVENSEHKFVLKDKNKPIIFSMARLDRVKNMTGLVEMFGKNAHLKDLANLVIVAGDHGKESKDREEQAEFKRMYSLIEEYKLEGHIRWISAQMNRVRNAELYRYICDTKGAFVQPAFYEAFGLTVVEAMTCGLPTIATCHGGPAEIIVNGVSGLHIDPYHSDKAADILVNFFEKSTADPTYWDKMSEGGLKRIYEKYTWKLYSERLMTLTGVYGFWKYVSNLERRETRRYLEMFYALKYRSLAAAVPLAVDGENTDN

SEQ ID NO: 170 - protein, 815 aa, Lolium perenne
MGEAAGDRVLSRLHSVRERIGDSLSAHPNELVAVFTRLVNLGKGMLQPHQIIAEYNTAIPEAEREKLKDGAFEDVLRAAQEAIVISPWVALAIRPRPGVWEYVRVNVSELAVEELSVPEYLQFKEQLVEGSNKDFVLELDFEPFNASFPRPSLSKSIGNGVQFLNRHLSSKLFHDKESMYPLLNFLRAHNYKGMPMMMNDRVRSLSALQGALRKAEEHLSGLPADTPYSDFHHRFQELGLEKGWGDCAKRAQETLHLLLDLLEAPDPSTLEKFLGTIPMVFNVVILSPHGYFAQANVLGYPDTGGQVVYILDQVRAMENEMLLRIKQQGLDITPRILIVTRLLPDATGTTCGQRLEKVLGTEHTHILRVPFRTENGIVRKWISRFEVWPYLETFTDDVAHEISGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGMYRVVHGIDVFDPKFNIVSPGADMSIYFPYSESQRRLTSLHPEIEELLYSDVDNDEHKFVLKDRNKPIIFSMARLDRVKNLTGLVELYGRNPRLQELVNLVVVCGDHGNPSKDKEEQAEFKKMFDLIEQYNLNGHIRWISAQMNRVRNAELYRYICDTKGAFVQPAFYEAFGLTVIEAMTCGLPTFATAYGGPAEIIVNGVSGYHIDPYQGDKASALLVEFFEKCQGDHSHWTKISLGGLQRIEEKYTWKLYSERLMTLTGVYGFWKYVSNLERRETRRYLEMLYALKYRTMASTVPLAVEGEPSSK

SEQ ID NO: 171 - protein, 581 aa, Festuca arundinacea
MAQAWAFFLLALFSFSSYVSRIFLCSRNGEGSFLCARAPEVPSIASDRYRTAYHFQPHKNWMNDPNGPMYYNGIYHLFFQHNPNGPQWGDIVWGHSVSTDLVNWIILEPAIEPDTPGDIKGCWSGSATVISGSQPVIMYTGGDVENHQVQNIALPKNRSDPYLIEWTKACNNPVLQPVGPGMNPGEFRDPTTGWIGPDGLWRISIGAEVNGYSAALLYKSEDFLNWSRVDHPLYSSSASTMWECLDFFAVLPGSNGGLDLSAAIPKGAKHVLKVSVDQCDKYMIGVYDLEHDAFVPDTILDDRWLLPRIDYGNYYASKSFFDSKNRRRIIWGWTNESDSSSDDVAKGWAGIYAIPRTIWLDRDGKQLLQWPVEEIESLRRNEINYQGLDLEKGDLYEIKGVDTLQADVEIDFELTSIDDADSFDPSWLLDPEKHCREAGASVHGGIGPFGLVILATGDMEEHTVVHFRVYKSQKEYMILMCSDIRRSSLRQGLYAPAYGGFFEFDLEKERKISLRTLIDRSAVESFGGGGRVCIIARVYPVAIVDDGSAHMYAFNNGSTTVRVPQIRAWSMMTAQVNLKKG

SEQ ID NO: 172 - protein, 562 aa, Lolium perenne
MNGIEHPGNGRTAYHFQPAKHWQNDPNGPMYHNGLYHFFYQYNPHGPTWDTGKLSWGHSVSGDLVNWAALDNALDPTAPFDANGCWSGSATILPGGRPAILYTGIDADKVQVQNVAFAKDPSDPLLREWEKPSCNPVIPYPADVTGNNFRDPTEAWRGRDGLWRVGIVAEVKGVGSLLVYRSADFLRWQRNAAPLHASSRDVPVLECPDLFPVAAAAQGATEGLETSAPSGAGVRHVLKLTDFAKEDHYMVGFYDDVADTFVPAEPERGDDPDNWRRLDHGHLYASKSFYDARNKRRILWAWVDETDGGGVARGWAGIQAFPRAMWLDADGKRLVQWPVEEIETLRRKRVGLRWATDVEAGGRKEIAGIVSSQADVEVVFEIPNLEEAETLDPEWVLDPKGLCAAKGASVHGGVGPFGLLVLASGDLEEHTAVFFRVFKHDGKYKVLMCTDLTKSSTKAGAHKPSYGAFLDVDVEKDKFISLRTLIDHTVVESFGDGGRTCMTARVYPEHAAMGSTHLYVFNNGTGAVKVSKLEAWELATAAVNGGSLAPVVVKASDPKEAL

SEQ ID NO: 173 - protein, 580 aa, Festuca arundinacea
MAHAWAFFLLALFSFSSCVSKLFIYSRNGEGSFLCTRSPEVPSIASKRYRTAYHFQSPKNWINDPCGPMYYNGIYHEFYQYNPGGTIAANIVWGHSVSTDLVNWIQLEPAIVRDTPYDIHGCWTGSITILPGDQPVIIYTGRDSDNHQSQNIELPKNRSDPYLREWTKADNNPRILPVGPDLNLTQFRDPTTGWIGPDGLWRIAIGAELNGYGAALLYKSEDFLNWTRVDHPLYSDNAPSMWECPDFFAVLPGNNGGLDLSAAIPKGAKHVLKMSVDYSDKYMIGVYDLKRDAFVPDVVLDDRRLWLRIDYGTFYASKSFFDSKRGRRVIWGWSNETDSVSDDGAKGWAGIHAIPRSIWLDSDGKQLLQWPIDEIESLRRDEINHQGLELKNGDLFEIKGIDTLQADIEVDFELTSIDSADPFDPSWLLDVERHCREAGASVQGGIGPFGLVVLASDNMEEHIAVHFRVYKSQKSHMILMCSDLRRSSLRSGLYTPAYGGFFEFDLEKERKISLRTLIDRSAVESFGGGGRVCITARIYPVALVDGRVHMYAFNNGSTTVRVPQLGAWSMMTAQVNVNKG

SEQ ID NO: 174 - protein, 569 aa, Festuca arundinacea Lolium perenne
MAQGWPFFLLVLFSSCVSNHLVNGERVFLFPQSHKVSSIVSKRYRTAYHFQPPKNWINGPMYYNGIYHEFYQYNPNGSLWGNIIWGHSVSTDLINWIPVEPAIERDIPSDINGCWTGSATIISGDQPIIIYTGADKENRQLQNIVLPKNKSDPYLREWTKAGNNPVIQPVGPGLNASQFRDPTTGWIGPDGLWRIAVGAELNGYGAALLYKSQDFLNWTRVDHPLYSSNASSMWECPDFFAVLPGNSGGLDLSAEIPNGAKHVLKMSLDSCDKYMIGVYDLKSDTFMPDSVLDDRRLWSRIDHGNFYASKSFFDSKKGRRIIWGWTNETDSSSDDVAKGWAGIHAIPRTIWLDSYGKQLLQWPIEEIESLRRNEISHQGLELKKGDLFEIKGTDTSQADVEVDFELTSIDNADPFDPSWLLDVEKQCREAGASVQGGIGPFGLVVLASDNMEEHTAVHFRVYKSQQSYMILMCSDLRRSSLRSGMYTPAYGGFFEFDLQKERKISLRTLIDRSAVESFGGGGRVCIMARVYPVVLVDDGGAHMYAFNNGSTTVRVPQLRAWSMSRAEHK

SEQ ID NO: 175 - protein, 588 aa, Lolium perenne
MGVRLGRVAWACPAVLVLLLQLAGASHVVYETSLLETEAAAATVPASIFELSTGYHFRPQKNWINDPNAPLYYKGWYHLFFQYNPKGAVWGNIVWAHSVSRDLINWVALETALAPSIDADKYGCWSGSATIMPDGTPVIMYTGVSRPDVNYEVQNVAFPKNSSDPLLREWVKPAHNPVIVPEGGINATQFRDPTTAWYADGHWRILVGALSGASRGVAYVYRSRDFRRWTRVRKPLHSAPTGMWECPDFYPVTVDGKESGVDTSVVSSSRVKHVLKNSLDLRRYDYYTVGTYDRLKERYVPDNPAGDKHHLRYDYGNFYASKTFYDPSKRRRILWGWANESDTAVDDVAKGWAGIQAIPRKVWLDPSGRQLMQWPVEEVEALRGKKPVSLKDRMVKRGEHVEVTGLQTAQADVEVSFEVPSLEGAEALDPALANDAQKLCGVKGADVEGGVGPFGLWVLASSKLEERTAVFFRVFKAAGNVNSTKPLVLMCSDPTKSSLNKNLYHPTFAGFVDIDMAKGKISLRSLIDQSVVESFGAGGRTCILSRVYPSLAIGRNAHLHVFNNGKADIKVSRLTAWEMKKPALMNGA

SEQ ID NO: 176 - protein, 670 aa, Lolium perenne
MPMEARDGVSMPYSYAALPEDAEAAVVGRGRRTGPLFAALLLTLVAALLAVAALAGVRLVGELPAGGVVMPNHPMEVMDVSGSRGPESGVSEKTSGAASESGGMLGADAGSNAFPWSNAMLQWQRTGFHFQPEKNWMNDPNGPVYYKGWYHLFYQYNPEGAIWGNKIAWGHAVSRDMLRWRHLPIAMFPDQWYDINGAWSGSATVLPDGRIVMLYTGSTNASVQVQCLAFPSDPSDPLLTNWTKYEGNPVLYPPPHVGEKDFRDPTTAWYDGSDGMWRIVIGSKDNRRAGMALTYKTKNFHDFELVPGVLHRVPATGMWECIDLYPVGGARGIDMTEAVAAASNSGGGEVLHVMKESSDDDRHDYYALGRYDAATNKWTPLDADADVGIGLRYDWGKFYASKTFYDPAKKRRVLWGWVGETDSERADVAKGWASLQSIPRTVVLDTKTGSNLIQWPVVEVETLRTNSTNLGSIIVEHGSVFPLSLHRATQLDIEASFRLDPLDVAAAKEADVGYNCSTSGGAAGRGALGPFGLLVLADARRHGGDTEQTAVYFYVARGLDGNLRTHFCHDESRSSRANDIVKRVVGNIVPVLDGEALSVRVLVDHSIVESFAQGGRSVVTSRVYPTEAIYANAGVYLFNNATGARVTATSLVVHEMDPSYNQNQAEMASL

SEQ ID NO: 177 - protein, 514 aa, Lolium perenne
MHADPNGPVYYRGWYHLFYQYNPEGAVWGNIAWGHAVSRDLVHWRHLPLAMVPDQWYDINGVWTGSATVFPDGTLNMLYTGSTNASVQAQCLAVPEDPNDSLLRNWTKHEANPVLLPPPGIGDKDFRDPTTAWFDESDQTWRTVIGSKDNNGHAGIAMVYKTKDFLNYELIPGYLHRVDGTGMWECIDFYPVGGKNGSEELYVIKESSDDDRHDWYTLGKYDAAANTFTAADPENDLGIGLRYDWGKFYASKTFYDPAKKRRVLWGWIGETDSERADVAKGWASLMSIPRTVELDEKTWTNLIQWPVEEIETLRIKSTDLGGITIDHGSVYPLPLHRATQLDIEASFRLDAATVAALNEADVGYNCSTSGGSTHRGALGPFGILVLADGKAEQTAVYFYVSKGLDGALETHFCHDESRSTLAKDVVKRVVGYTVPVLDGEAFSVRVLVDHSIVESFAMGGRSTATSRVYPTESIYGAAGAYLFNNATGGSVTVEKLVVHEMDSSYNQIFMADDL

SEQ ID NO: 178 - protein, 557 aa, Lolium perenne
MGSVPEESVVSVAAAETVFRSKLPDIEINNEQTLQSYCFEKMAEVASRPCIIDGQTGASYTYTEVDSLTRRAAAGLRRMGVGKGDVVMNLLRNCPEFAFSFLGAARLGAATTTANPFYTPHEIHRQAEAAGAKLIVTEACAVEKVLEFAAGRGLPVVTVDGRRDGCVDFAELIAGEELPEADEAGILPDDVVALPYSSGTTGLPKGVMLTHRSLVTSVAQLVDGSNPNVCFNKDDALLCLLPLFHIYSLHTVLLAGLRVGAAIVIMRKFDVGALVDLVRAHRITIAPFVPPIVVEIAKSDRVGADDLASIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEITENEIKQFVSKEVVFYKRINKVYFTDSIPKNPSGKILRKDLRARLAAGIPTEVAAPRS

SEQ ID NO: 179 - protein, 501 aa, Lolium perenne
MEVLLLEKALLGLFAAAVLAIAVAKLAGKRFRLPPGPSGAPIVGNWLQVGDDLNHRNLMGIAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATAGTVIRRRLQLMMYNDMFRIMFDRRFESVDDPLFNKLKAMNAERSILSQSFDYNYGDFIPILRPFLRKYLNRCTNLKTKRMKLFEDHFVADRKKALEQNGEIRCAMDHILEAERKGEINHDNVLYIVENINVAAIETTLWSIEWGIAELVNHPDVQSKLRDEMTAVLGADVAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIVLALPIIGITLGRLVQNFQLLPPPGQDKIDTTEKPGQFSNQILKHATVVCKPLEA

SEQ ID NO: 180 - protein, 361 aa, Lolium perenne
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVDKGLTSQIEVVKMDYLNQALERLERNDVRYRFVVDVAGSNIDDTAA

SEQ ID NO: 181 - protein, 363 aa, Lolium perenne
MTVVEVLAAGDAAAAAVARPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMDPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDEANPRKQPYKMSNQKLQDLGLEFRPVSQSLYETVKSLQEKGHLPVLSEQAEADKETLAAELQAGVTIRA

SEQ ID NO: 182 - protein, 360 aa, Festuca arundinacea
MGSTAADMAASADEEACMFALQLASSSILPMTLKNAIELGLLEILVAAGGKSLTPTEVAAKLPSAANPEAPDMVDRMLRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 183 - protein, 543 aa, Lolium perenne
MVGFAKIAMEWIQDPLSWLFIASVVFVVLQRRRRGNVAPFPPGPKPLPIVGNMSMMDQLTHRGLAALAKEYGGLLHIRLGKLHTFAVSTPEYAREVLQVQDGAFSNRPATIAIAYLTYDRADMAFAHYGPFWRQMRKLCVMKLFSRRRPETWLAVRDESAALVRAVARRTGESVDLGELIFKLTKNVIFRAAFGAGAVAADAEEGDGAGKQDEFIAILQEFSKLFGAFNIGDFIPWLSWADPQGINVRLRAARNALDEFIDKIIDEHMERGKNPDDADADMVDDMLAFLPEAKPKKGAAGDGVDDLQNTLRLTRDNIKAIIMDVMFGGTETVASAIEWAMAEMMHSPDDLRRLQQELVDVVGLDRNVDESDLDKLPFLKCVIKETLRLHPPIPLLLHETAEDCVVGGYSVPRGSRVMINVYAIGRDRRAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQLLGADDAGRQA

SEQ ID NO: 184 - protein, 713 aa, Festuca arundinacea
MECENGHVAANGDGLCVAQPARADPLNWGKAAEELSGSHLDAVKRMVEEYRRPVVTMEGASLTIAMVAAVAAGADTRVELDESARGRVKESSDWVMNSMANGTDSYGVTTGFGATSHRRTKEGGALQRELIRFLNAGAFGTGSDGHVLPAATTRAAMLVRVNTLLQGYSGIRFEILETIATLLNANVTPCLPLRGTITASGDLVPLSYIAGLVTGRPNSVATAPDGSKVNAAEAFKIAGIQHGFFELQPKEGLAMVNGTAVGSGLASIVLFEANILGILAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFMVALCQAIDLRHIEENVKNAVKNCVKTVARKTLSTNDSGHLHNARFCEKDLLLTIDREAVFAYADDPCSANYPLMQKMRAVLVEHALANGEAEQDVQTSVFAKLATFEQELRAVLPKEVESARCSVENGTAAQQNRISECRSYPLYRFVRKELGTEYLTGEKTRSPGEEVDKVFVAMNQGKHIDALLECLKEWNGEPLPIC

SEQ ID NO: 185 - protein, 324 aa, Lolium perenne
MAPATPKDSSALPGLLLLFAAATSVAVANAQLSENYYGSSCPTALLTIRTVVTTAVLLDHRMGASLLRLHFHDCFVQGCDASVLLDDTAGFTGEKGAGPNAGSLRGLEVIDKIKMLLEFMCPRTVSCADILAVAARDSVVRLGGPSWAVQLGRRDATTASASLASSDLPGPNSNLNDLLTAFSKKGLSTTDMVALSGAHTIGRAQCQNYRNRIYTDTDIDGAFAASLRGGCPQAGGDGNLAPLDASSPNTFDNGYFSGLLSRQGLLHSDQALYDGGSTDDLVRTYASNNDQFGSDFAAAMVKLSNIGLLTGSSGEIRVNCRAVN

SEQ ID NO: 186 - protein, 398 aa, Lolium perenne
MAATMTVEEVRKAQRAEGPATVLAIGTATPANCVYQADYPDYYFKITKSDHLADLKEKFKRMCDKSQIRKRYMHLTEEILEENPNMCAYMAPSLDARQDIVVVEVPKLGKAAAQKAIKEWGQPRSKITHLVFCTTSGVDMPGADYQLTKMLGLRPSVKRLMMYQQGCFAGGTVLRLAKDLAENNRGARVLVVCSEITAVTFRGPHESHLDSLVGQALFGDGAAAVIIGADPDVSVERPLFQLVSASQTILPDSEGAIDGHLREVGLTFHLLKDVPGLISKNIERALEEAFKPLGIDDWNSVFWVAHPGGPAILDMVEAKVNLNKERMRATRHVLSEYGNMSSACVLFIMDEMRKRSAEDGHTTTGEGMDWGVLFGFGPGLTVETVVLHSMPIAADATA

SEQ ID NO: 187 - protein, 370 aa, Festuca arundinacea
MKQEVKSEMNGETMSGNKGPVVVTGASGFVGSWLVMKLLQAGYTVRATVRDPGNVEKTKPLLELPGAKERLSIWRADLSEEGSFDEAIAGCTGVFHVATPMDFESKDPENEVIKPTVEGMLSIMRACKEAGTVKRVVFTSSAGTVNIEERPRPAYDQDNWSDIDFCRRVKMTGQMYFVSKSLAEKAAMDYAKENGVDFISIIPTLVVGPFLSAGMPPSLVTALALITGNEAHYSILKQVQLVHLDDLCDSMTYLFEHPDANGRYICSSHDTTIHGIARMLKERFPEYDIPQKFPGVDDDLQPIHFFFKKLLDHGFRFRYTAEDMFDAAVWTCREKGLIPLGAEGAGGPASAAGKLGAVLVGEGQAIGAET

SEQ ID NO: 188 - protein, 329 aa, Lolium perenne
MATEAKGETVLVTGASGFIGSWLVRLLLARGYSVHAAVLNPDDKAETDHLLALAAAAGDEGRIRFFRCDLLDGAAMLAAVRGCSGVFHLASPCTVDLVLDPQKELVVPAVEGTLNVLRAAKEAGGVRRVVVTSSVSALVPCPGWPAGEVLDERCWTDIDYCDKNGVWYPASKALAEKAAWKFAEENGLDVVTVNPGTVLGEMIPPRLNASMAMFLRLLEGCKEEYADFFIGPVHVEDVALAHILLYENPSASGRHLCVEPICHWSVFAAKVAELYPDYKVPKFPEDTQPGLVRAEAVPKKLMALGLQFTPLEKIIRDAVESLKSRGCIA

SEQ ID NO: 189 - protein, 330 aa, Lolium perenne
MVSSTKGKVCVTGASGFVASWLIKKLLESGYHVIGTVRDPGNRRKVGHLWKLPGANERLQLVRADLLEEGSFDDAVRACEGVFHIASPVLGKSDSNCKEATLGPAINGTLNVLRSCKKSPFLKRVVLTSSSSAVRIRDETQQPELLWDETTWSSVPLCEKLQLWYALAKVFAEKAALDFAKENNIDLVTVLPSFVIGPSLSHELCTTASDILGLLQGDTDRFTLYGRMGYVHIDDVARSHILVYETPEATGRYLCSSVVLDNNELVGLLAKQFPVFPIPRRLKNPYGKQAYQLDTSKLQGLGLKFKGVQEMFNDCVESLKDQGHLLECPL

SEQ ID NO: 190 - protein, 326 aa, Lolium perenne
MAPATPKDSSSSALPGLLLLLAAATSVAVANAQLSENYYGSSCPTALLTIRTVVTTAVLLDHRMGASLLRLHFHDCFVQGCDASVLLDDTAGFTGEKGAGPNAGSLRGLEVIDKIKMLLEFMCPRTVSCADILAVAARDSVVRLGGPSWAVQLGRRDATTASASLASSDLPGPNSNLNDLLTAFSKKGLSTTDMVALSGAHTIGRAQCQNYRNRIYTDTDIDGAFAASLRGGCPQAGGDGNLAPLDASSPNTFDNGYFSGLLSRQGLLHSDQALYDGGSTDDLVRTYASNNDQFGSDFAAAMVKLSNIGLLTGSSGEIRVNCRAVN

SEQ ID NO: 191 - DNA, 26 bp, Artificial Sequence
  Made in the lab
catatggataagctcaatggttctgc

SEQ ID NO: 192 - DNA, 21 bp, Artificial Sequence
  Made in the lab
cggtagagatccagtctagag

SEQ ID NO: 193 - DNA, 28 bp, Artificial Sequence
  Made in the lab
tacatatgctgcacgagaagttctacag

SEQ ID NO: 194 - DNA, 21 bp, Artificial Sequence
  Made in the lab
ccacggctaactaatggttca

SEQ ID NO: 195 - DNA, 29 bp, Artificial Sequence
  Made in the lab
tacatatgaaaggttctgggctgtccgtc

SEQ ID NO: 196 - DNA, 22 bp, Artificial Sequence
  Made in the lab
ctagttcaccttggagcagttg

SEQ ID NO: 197 - DNA, 18 bp, Artificial Sequence
  Made in the lab
gcagacggcggtctactt

SEQ ID NO: 198 - DNA, 23 bp, Artificial Sequence
  Made in the lab
aaatgcaagtgacccaacgttac

SEQ ID NO: 199 - DNA, 20 bp, Artificial Sequence
  Made in the lab
tcatgacgattccaagaacg

SEQ ID NO: 200 - DNA, 19 bp, Artificial Sequence
  Made in the lab
gttgaccgtgactcgtcgt

SEQ ID NO: 201 - DNA, 27 bp, Artificial Sequence
  Made in the lab
actgaattctcggtcccagcctccatt

SEQ ID NO: 202 - DNA, 29 bp, Artificial Sequence
  Made in the lab
gtagcggccgcgcgaaaactcgtcggaga

SEQ ID NO: 203 - DNA, 27 bp, Artificial Sequence
  Made in the lab
gctgaattcctccgatggctctctgac

SEQ ID NO: 204 - DNA, 28 bp, Artificial Sequence
  Made in the lab
atgcggccgcaagtccaatcggccacac

SEQ ID NO: 205 - DNA, 25 bp, Artificial Sequence
  Made in the lab
tatgaattcggcgccgacgccggca

SEQ ID NO: 206 - DNA, 27 bp, Artificial Sequence
  Made in the lab
atgcggccgcgcaacatgctagcacaa

SEQ ID NO: 207 - DNA, 19 bp, Artificial Sequence
  Made in the lab
aaacagaagtagcggcggc

SEQ ID NO: 208 - DNA, 18 bp, Artificial Sequence
  Made in the lab
ggtcgtagaaggacttgg

SEQ ID NO: 209 - DNA, 18 bp, Artificial Sequence
  Made in the lab
cgccttcatcttcaagac

SEQ ID NO: 210 - DNA, 17 bp, Artificial Sequence
  Made in the lab
agccctggcgtaaatgg

SEQ ID NO: 211 - DNA, 20 bp, Artificial Sequence
  Made in the lab
gacgcaaggagagatccaga

SEQ ID NO: 212 - DNA, 20 bp, Artificial Sequence
  Made in the lab
agacgaggtgggtgatcttg

SEQ ID NO: 213 - DNA, 20 bp, Artificial Sequence
  Made in the lab
tccatcctcttcacccactc

SEQ ID NO: 214 - DNA, 20 bp, Artificial Sequence
  Made in the lab
ggcagcggtttctttattca

SEQ ID NO: 215 - DNA, 20 bp, Artificial Sequence
  Made in the lab
ggccatgtttcttcgcttac

SEQ ID NO: 216 - DNA, 20 bp, Artificial Sequence
  Made in the lab
ctacgacggaagggtgacat

SEQ ID NO: 217 - DNA, 20 bp, Artificial Sequence
  Made in the lab
gtggacatggaccagaaggt

SEQ ID NO: 218 - DNA, 20 bp, Artificial Sequence
  Made in the lab
cggtacatctcggtgaaggt

SEQ ID NO: 219 - protein, 16 aa, Festuca Arundinacea
GTITASGDLVPLSYIA

We claim:

1. An isolated polynucleotide comprising SEQ ID NO: 151.

2. A genetic construct comprising the isolated polynucleotide of claim 1.

3. An isolated transgenic cell comprising the construct according to claim 2.

4. A recombinant construct comprising, in the 5'–3' direction:
   (a) a gene promoter sequence;
   (b) a polynucleotide sequence comprising nucleotides 87–1,718 of SEQ ID NO: 151; and
   (c) a gene termination sequence.

5. The construct of claim 4, wherein the polynucleotide is in the sense orientation.

6. A transgenic plant cell comprising the construct of claim 4.

7. A transgenic plant comprising the transgenic plant cell according to claim 6, or fruit or seeds or progeny thereof, wherein the fruit, seeds or progeny thereof comprise a recombinant construct comprising, in the 5'–3' direction:
   (a) a gene promoter sequence;
   (b) a polynucleotide sequence comprising nucleotides 87–1,718 of SEQ ID NO: 151; and
   (c) a gene termination sequence.

8. A method for modulating the lignin composition of a plant, comprising stably incorporating into the genome of the plant the polynucleotide of claim 1, expressing said polynucleotide, thereby modulating the lignin composition of the plant.

9. The method of claim 8, wherein the plant is a grass.

10. The method of claim 9, wherein the plant is selected from the group consisting of *Lolium perenne* and *Festuea arundinacea*.

11. The method of claim 8 comprising stably incorporating into the genome of the plant a recombinant construct comprising, in the 5'–3' direction:
   (a) a gene promoter sequence;
   (b) a polynucleotide sequence comprising nucleotides 87–1,718 of SEQ ID NO:151; and
   (c) a gene termination sequence.

12. A method for producing a plant having altered lignin composition, comprising:
   (a) transforming a plant cell with the construct of any one of claims 2 and 4 to provide a transgenic cell;
   (b) expressing said polynucleotide, thereby altering the lignin composition; and
   (c) cultivating the transgenic cell under conditions conducive to regeneration and mature plant growth.

13. A method for increasing the amount of an enzyme involved in a lignin biosynthetic pathway in a plant comprising stably incorporating into the genome of the plant the construct of any one of claims 2 and 4, expressing said polynucleotide, thereby increasing the amount of the encoded enzyme which is involved in a lignin biosynthetic pathway.

14. An isolated polynucleotide that encodes SEQ ID NO:183.

15. An isolated polynucleotide comprising a sequence selected from the group consisting of:
   (a) full-length complement of SEQ ID NO: 151;
   (b) frill-length reverse complement of SEQ ID NO: 151; and
   (c) frill-length reverse sequence of SEQ ID NO: 151.

16. A recombinant genetic construct comprising the polynucleotide of claim 15.

17. A transgenic cell comprising the recombinant genetic construct of claim 16.

18. A transgenic plant comprising a transgenic plant cell according to claim 3, or fruit or seeds or progeny thereof, wherein the fruit, seeds or progeny thereof comprise a recombinant construct comprising SEQ ID NO: 151.

* * * * *